US012698513B2

(12) United States Patent
Baram et al.

(10) Patent No.: US 12,698,513 B2
(45) Date of Patent: Aug. 4, 2026

(54) CRISPR COMPOSITIONS AND METHODS FOR PROMOTING GENE EDITING OF RIBOSOMAL PROTEIN S19 (RPS19) GENE

(71) Applicant: EmendoBio Inc., Wilmington, DE (US)

(72) Inventors: David Baram, Tel Aviv (IL); Lior Izhar, Tel Aviv (IL); Asael Herman, Ness-Ziona (IL); Rafi Emmanuel, Ramla (IL); Michal Golan Mashiach, Ness-Ziona (IL); Joseph Georgeson, Rehovot (IL)

(73) Assignee: EmendoBio Inc., Wilmington, DE (US)

( * ) Notice: Subject to any disclaimer, the term of this patent is extended or adjusted under 35 U.S.C. 154(b) by 1187 days.

(21) Appl. No.: 17/428,880

(22) PCT Filed: Feb. 4, 2020

(86) PCT No.: PCT/US2020/016643
§ 371 (c)(1),
(2) Date: Aug. 5, 2021

(87) PCT Pub. No.: WO2020/163379
PCT Pub. Date: Aug. 13, 2020

(65) Prior Publication Data
US 2022/0098621 A1    Mar. 31, 2022

Related U.S. Application Data

(60) Provisional application No. 62/861,183, filed on Jun. 13, 2019, provisional application No. 62/801,603, filed on Feb. 5, 2019.

(51) Int. Cl.
| | |
|---|---|
| *A61P 7/06* | (2006.01) |
| *A61K 31/7105* | (2006.01) |
| *A61K 35/28* | (2015.01) |
| *C12N 5/0789* | (2010.01) |
| *C12N 9/22* | (2006.01) |
| *C12N 15/11* | (2006.01) |
| *C12N 15/90* | (2006.01) |

(52) U.S. Cl.
CPC ........ *C12N 15/907* (2013.01); *A61K 31/7105* (2013.01); *A61K 35/28* (2013.01); *A61P 7/06* (2018.01); *C12N 5/0647* (2013.01); *C12N 9/22* (2013.01); *C12N 15/11* (2013.01); *C12N 2310/20* (2017.05); *C12N 2501/125* (2013.01); *C12N 2501/22* (2013.01); *C12N 2501/2303* (2013.01); *C12N 2510/00* (2013.01); *C12N 2800/80* (2013.01)

(58) Field of Classification Search
None
See application file for complete search history.

(56) References Cited

U.S. PATENT DOCUMENTS

2014/0170753 A1* 6/2014 Zhang ................... C12N 15/63
435/320.1

FOREIGN PATENT DOCUMENTS

WO    WO-2017191187 A2 * 11/2017    ......... G01N 33/5026

OTHER PUBLICATIONS

Clancy, S. (2008) RNA Functions. Nature Education 1(1):102 (Year: 2008).*
Bernat et al. RNA Structures as Mediators of Neurological Diseases and as Drug Targets. Neuron. Jul. 1, 2015;87(1):28-46. (Year: 2015).*
Nowak et al. Guide RNA engineering for versatile Cas9 functionality. Nucleic Acids Res. Nov. 16, 2016;44(20):9555-9564. Epub Oct. 12, 2016. (Year: 2016).*
International Preliminary Report on Patentability issued Aug. 10, 2021 including Written Opinion of the International Searching Authority issued Jul. 5, 2020, in connection with PCT International Application No. PCT/US2020/016551.
International Search Report issued Jul. 17, 2020 in connection with PCT International Application No. PCT/US2020/016643.
Written Opinion (form PCT/ISA/237) issued Jul. 17, 2020 in connection with PCT International Application No. PCT/US2020/016643.
Aguirre, A. J. "Genomic Copy Number Dictates a Gene-Independent Cell Response to CRISPR/Cas9 Targeting." Cancer Discovery, vol. 6, No. 8, Jun. 3, 2016, pp. 914-929 and Supplementary data.
Anonymous: "Diamond Blackfan Anemia Foundation Hosts 14th DBA International Consensus Conference." 2016.
Anonymous: "NM_001022. 3 (RPS19):c.—339T>C." ClinVar Database, Jun. 14, 2016.
Aspesi, A. et al. "Emerging Therapeutic Approaches for Diamond Blackfan Anemia." Current Gene Therapy, vol. 18, No. 6, Dec. 12, 2018, pp. 327-335.
Campagnoli, M. F. "RPS19 Mutations in Patients With Diamond-Blackfan Anemia." Human Mutation, vol. 29, No. 7, Apr. 15, 2008, pp. 911-920.
Da Costa, L. "Molecular approaches to diagnose Diamond-Blackfan anemia: The EuroDBA experience." European Journal of Medical Genetics, vol. 61, No. 11, Oct. 26, 2017, pp. 664-673.
Doench, J. G. et al. "Optimized sgRNA design to maximize activity and minimize off-target effects of CRISPR-Cas9." Nature Biotechnology, vol. 34, No. 2, Jan. 18, 2016, pp. 184-191 and Tables S21-S22.

(Continued)

*Primary Examiner* — Valarie E Bertoglio
*Assistant Examiner* — Briana N Ebbinghaus
(74) *Attorney, Agent, or Firm* — Faegre Drinker Biddle & Reath LLP

(57) ABSTRACT

Isolated guide RNA (gRNA) molecules comprising CRISPR (crRNA) molecules that target the 19:41869823_T_C mutation of a Ribosomal Protein S19 (RPS19) allele.

10 Claims, 3 Drawing Sheets

Specification includes a Sequence Listing.

(56) References Cited

OTHER PUBLICATIONS

Westin, E. et al. "Correction of Diamond-Blackfan Induced Pluripotent Stem Cells via CRISPR." Abstracts of "Molecules for Minions: Southeastern Pediatric Research Innovation Conference," Jun. 22, 2016, Atlanta, p. 17.

Westin, E. et al. "Crispr Modification of Induced Pluripotent StemDerived from Diamond-Blackfan Anemia Fibroblasts." Blood, vol. 124, No. 21, Dec. 6, 2014.

* cited by examiner

CRISPR COMPOSITIONS AND METHODS FOR PROMOTING GENE EDITING OF RIBOSOMAL PROTEIN S19 (RPS19) GENE

CROSS-REFERENCE TO RELATED APPLICATIONS

This application is a $371 national stage of PCT International Application No, PCT/US2020/016643, filed Feb. 4, 2020, claiming the benefit of U.S. Provisional Applications Nos. 62/861,183, filed Jun. 13, 2019, and 62/801,603, filed Feb. 5, 2019, the contents of each of which are hereby incorporated by reference into the application.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide and/or amino acid sequences which are present in the file named "210805_90838-A-PCT-US_Sequence_Listing_LMO.txt," which is 3740 kilobytes in size, and which was created Jul. 21, 2021 in the IBM-PC machine format, having an operating system compatibility with MS-Windows, which is contained in the text file filed Aug. 5, 2021 as part of this application.

BACKGROUND OF INVENTION

There are several classes of DNA variation in the human genome, including insertions and deletions, differences in the copy number of repeated sequences, and single nucleotide polymorphisms (SNPs). A SNP is a DNA sequence variation occurring when a single nucleotide (adenine (A), thymine (T), cytosine (C), or guanine (G)) in the genome differs between human subjects or paired chromosomes in an individual. Over the years, the different types of DNA variations have been the focus of the research community either as markers in studies to pinpoint traits or disease causation or as potential causes of genetic disorders.

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit(s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Additional examples include dominant negative mutations, which have a gene product that acts antagonistically to the wild-type allele. Other examples include haploinsufficiency, that may be caused by a loss of function mutation in which a reduced dosage of a normal gene product is not sufficient to produce the normal phenotype.

Diamond Blackfan Anemia

Diamond Blackfan anemia (DBA) primarily affects the bone marrow, which produces new blood cells. People with this condition often also have physical abnormalities affecting various parts of the body. DBA patients were found to possess mutations in the ribosomal protein genes. Genes susceptible for the mutations in DBA patients include RPL3, RPL5, RPL11, RPL15, RPL26, RPL31, RPL35A, RPL36, RPS7, RPS10, RPS14, RPS17, RPS19, RPS24, RPS26 and RPS29 gene. A variety of mutations in RPS19 gene including whole gene deletions, translocations, truncating mutations (nonsense or frameshift) or missense mutations were identified in DBA patients. The RPS19 gene encodes a ribosomal protein that is a component of the 40S subunit. The protein belongs to the S19E family of ribosomal proteins. The RPS19 gene mutations that cause Diamond-Blackfan anemia are believed to cause problems with ribosomal function. Studies indicate that a shortage of functioning ribosomes may increase apoptosis of blood-forming cells in the bone marrow, resulting in a low number of red blood cells (anemia).

SUMMARY OF THE INVENTION

Disclosed is an approach for repairing an allele bearing a disease-associated mutation ("mutant allele") by utilizing an RNA guided DNA nuclease to edit/correct/modify the nucleic acid sequence of the mutant allele such as to express a functional protein. In some embodiments, the approach is for repairing an allele bearing a dominant disease-associated mutation. The method of the enclosed invention may utilize allele-specific or non-discriminatory guide sequences to target and correct a disease-associated mutation.

According to some embodiments, the present disclosure provides a method for differentiating between the mutant allele and the wild type allele of a gene in order to edit only the mutant allele. In some embodiments, the differentiation is based on designing a guide RNA that targets a difference in sequence between the mutant allele and the functional allele. Such difference may be due to a heterozygous SNP, or a heterozygous disease-causing mutation.

According to some embodiments, the method utilizes at least one naturally occurring nucleotide difference or polymorphism (e.g., single nucleotide polymorphism (SNP)) between two alleles of a gene, to target an allele of a gene bearing a mutation causing a disease phenotype and a particular sequence in the SNP position. For example, a mutant allele in a cell can be specifically targeted based on a SNP and/or mutation sequence relative to another functional or wild-type allele in a cell which lacks the SNP and/or mutation. In some embodiments, a particular sequence in the SNP position is utilized for distinguishing/discriminating between two alleles of a gene, one allele bearing a mutation such that it encodes a mutated protein causing a disease phenotype ("mutant allele"), and the other allele encoding for a functional/normal/wild type protein ("functional allele"), such as to target the mutant allele bearing both a particular sequence in the SNP position and a disease associated mutation. In some embodiments, the disease-associated mutation is targeted. In some embodiments, the method further comprises the step of allele cleavage by a CRISPR nuclease. The allele cleavage is selected from the group consisting of a double strand break (DSB) and a single strand break. In some embodiments, the method further comprises the step of correction of the allele such that the corrected allele results in an expression of a functional RPS19 protein. In some embodiments, the correction is performed by homology directed repair (HDR). In some embodiments, the allele is altered such that it no longer possesses dominant negative properties.

According to embodiments of the present invention, there is provided an RNA molecule comprising a guide sequence portion having 17-25 nucleotides in the sequence of 17-25 contiguous nucleotides set forth in any one of SEQ ID NOs: 1-20465.

According to some embodiments of the present invention, there is provided a composition comprising an RNA molecule comprising a guide sequence portion having 17-25 contiguous nucleotides containing nucleotides in the sequence set forth in any one of SEQ ID NOs 1-20465 and a CRISPR nuclease. In some embodiments, the composition further comprises a nucleic acid template for homology-directed repair, alteration, or replacement of a target sequence of an allele comprising the disease-associated mutation.

According to some embodiments of the present invention, there is provided a method for repairing or correcting a mutant RPS19 allele in a cell, the method comprising delivering to the cell a composition comprising an RNA molecule comprising a guide sequence portion having 17-25 contiguous nucleotides containing nucleotides in the sequence set forth in any one of SEQ ID NOs 1-20465 and a CRISPR nuclease. In some embodiments, a nucleic acid template is further provided to the cell for homology-directed repair, alteration, or replacement of a target sequence of the mutant RPS19 allele. In some embodiments, an endogenous template is utilized to repair, alter, or replace the target sequence of the mutant RPS19 allele. In some embodiments, non-templated repair alters the RPS19 allele.

According to some embodiments of the present invention, there is provided a method for treating, preventing or ameliorating a condition in a subject having Diamond-Blackfan anemia (DBA), the method comprising delivering to the subject a composition comprising an RNA molecule comprising a guide sequence portion having 17-25 contiguous nucleotides containing nucleotides in the sequence set forth in any one of SEQ ID NOs 1-20465 and a CRISPR nuclease. In some embodiments, a nucleic acid template is further provided to the cell for homology-directed repair, alteration, or replacement of a target DNA sequence comprising the pathogenic mutation. In some embodiments, an endogenous template is utilized to repair, alter, or replace the target sequence of the mutant RPS19 allele. In some embodiments, non-templated repair alters the RPS19 allele.

In some embodiments, the method is performed ex-vivo and the cell is provided or explanted from an individual patient. In some embodiments, the method further comprises the step of introducing the resulting cell with the corrected, repaired, or modified mutant RPS19 allele, into the individual patient (e.g. autologous transplantation).

According to some embodiments of the present invention, there is provided use of a composition comprising an RNA molecule comprising a guide sequence portion having 17-25 contiguous nucleotides containing nucleotides in the sequence set forth in any one of SEQ ID NOs 1-20465 and a CRISPR nuclease for repairing/correcting/editing a mutant RPS19 allele in a cell, comprising delivering to the cell the composition comprising an RNA molecule comprising a guide sequence portion having 17-25 contiguous nucleotides containing nucleotides in the sequence set forth in any one of SEQ ID NOs 1-20465 and a CRISPR nuclease.

According to embodiments of the present invention, there is provided a medicament comprising an RNA molecule comprising a guide sequence portion having 17-25 contiguous nucleotides containing nucleotides in the sequence set forth in any one of SEQ ID NOs 1-20465 and a CRISPR nuclease for use in inactivating repairing/correcting/editing a mutant RPS19 allele in a cell, wherein the medicament is administered by delivering to the cell the composition comprising an RNA molecule comprising a guide sequence portion having 17-25 contiguous nucleotides containing nucleotides in the sequence set forth in any one of SEQ ID NOs 1-20465 and a CRISPR nuclease. In some embodiments, the medicament further comprises a nucleic acid template.

According to some embodiments of the present invention, there is provided use of a composition comprising an RNA molecule comprising a guide sequence portion having 17-25 contiguous nucleotides containing nucleotides in the sequence set forth in any one of SEQ ID NOs 1-20465 and a CRISPR nuclease for treating ameliorating or preventing DBA, comprising delivering to cells of a subject having or at risk of having DBA, the composition comprising an RNA molecule comprising a guide sequence portion having 17-25 contiguous nucleotides containing nucleotides in the sequence set forth in any one of SEQ ID NOs 1-20465 and a CRISPR nuclease.

According to some embodiments of the present invention, there is provided a medicament comprising the composition comprising an RNA molecule comprising a guide sequence portion having 17-25 contiguous nucleotides containing nucleotides in the sequence set forth in any one of SEQ ID NOs 1-20465 and a CRISPR nuclease for use in treating ameliorating or preventing DBA, wherein the medicament is administered by delivering to a subject having or at risk of having DBA the composition comprising an RNA molecule comprising a guide sequence portion having 17-25 contiguous nucleotides containing nucleotides in the sequence set forth in any one of SEQ ID NOs 1-20465 and a CRISPR nuclease.

According to some embodiments of the present invention, there is provided a kit for correcting/repairing a mutant RPS19 allele in a cell, comprising an RNA molecule comprising a guide sequence portion having 17-25 contiguous nucleotides containing nucleotides in the sequence set forth in any one of SEQ ID NOs 1-20465, a CRISPR nuclease, and optionally a tracrRNA molecule; and instructions for delivering the RNA molecule; CRISPR nuclease, and/or the tracrRNA to the cell. In some embodiment, the delivery is performed ex-vivo. In some embodiments, the delivery is performed within a subject's body. In some embodiments, the cells are HSC cell originated from the subject.

According to some embodiments of the present invention, there is provided a kit for treating DBA in a subject, comprising an RNA molecule comprising a guide sequence portion having 17-25 contiguous nucleotides containing nucleotides in the sequence set forth in any one of SEQ ID NOs 1-20465, a CRISPR nuclease, and optionally a tracrRNA molecule; and instructions for delivering the RNA molecule; CRISPR nuclease, and optionally the tracrRNA to a subject having or at risk of having DBA. According to some embodiments of the present invention, there is provided a kit for treating DBA in a subject, comprising an RNA molecule comprising a guide sequence portion having 17-25 contiguous nucleotides containing nucleotides in the sequence set forth in any one of SEQ ID NOs 1-20465, a CRISPR nuclease, and optionally a tracrRNA molecule; and instructions for delivering the RNA molecule; CRISPR nuclease, and optionally the tracrRNA to cells of the subject having or at risk of having DBA. In some embodiments, the cells are HSC cells obtained from the subject and the delivery is ex-vivo.

The present invention also provides a method for repairing, correcting, or modifying a gene bearing a dominant disease-associated mutation. The method utilizes at least one guide sequence for targeting a CRISPR nuclease to a target sequence in a non-coding region of a gene bearing a mutation causing a disease phenotype. In some embodiments, the targeting is to a non-coding region of each of two alleles of the gene, one allele bearing a mutation such that it encodes a mutated protein causing a disease phenotype ("mutant allele"), and the other allele encoding for a functional/ normal/wild type protein ("functional allele"). In some embodiments, the target sequence is in a distance of up to 1000, 900, 800, 700, 600, 500, 400, 300, 200 base pairs from the edges of an exon bearing the mutation causing the disease phenotype. Each possibility represents a separate embodiment. In some embodiments, the method further comprises the step of allele cleavage by a CRISPR nuclease. The allele cleavage is selected from the group consisting of: a double strand break (DSB) and a single strand break. In some embodiments, the method further comprises the step of correction of the allele such that the corrected allele results in an expression of a functional RPS19 protein. In some embodiments, the correction is performed by homology directed repair (HDR).

The present invention provides for a method for modifying in a cell a mutant allele of the Ribosomal Protein S19 gene (RPS19 gene) having a mutation associated with Diamond Blackfan anemia (DBA), the method comprising introducing to the cell a composition comprising:

a CRISPR nuclease or a sequence encoding the CRISPR nuclease; and a first RNA molecule comprising a guide sequence portion having 17-25 nucleotides or a nucleotide sequence encoding the same, wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA.

The present invention also provides for a modified cell obtained by any of the methods of the present invention.

The present invention provides for a composition comprising the modified cells of the present invention and a pharmaceutically acceptable carrier.

The present invention also provides for an in vitro or ex vivo method of preparing the compositions of the present invention, comprising mixing the cells with the pharmaceutically acceptable carrier.

The present invention provides for a method of preparing in vitro or ex vivo a composition comprising modified cells, the method comprising:

a) isolating HSPCs from cells obtained from a subject with an RPS19 gene mutation related to DBA and/or suffering from DBA, and obtaining the cell from the subject;

b) introducing to the cells of step (a) a composition comprising:

a CRISPR nuclease or a sequence encoding the CRISPR nuclease; and a first RNA molecule comprising a guide sequence portion having 17-25 nucleotides, wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA, optionally, introducing to the cells a donor DNA template for homology directed repair (HDR), alteration, or replacement of a target sequence of the RPS19 allele so as to modify the mutant allele of the RPS19 gene in one or more cells thereby obtaining modified cells; optionally c) culture expanding the modified cells of step (b), wherein the modified cells are capable of engraftment and giving rise to progeny cells after engraftment.

The present invention provides for use of a composition prepared in vitro by a method comprising:

a) isolating HSPCs from cells obtained from a subject with an RPS19 gene mutation related to DBA and/or suffering from DBA, and obtaining the cell from the subject;

b) introducing to the cells of step (a) a composition comprising:

a CRISPR nuclease or a sequence encoding the CRISPR nuclease; and a first RNA molecule comprising a guide sequence portion having 17-25 nucleotides, wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA, optionally, introducing to the cells a donor DNA template for homology directed repair (HDR), alteration, or replacement of a target sequence of the RPS19 allele so as to modify the mutant allele of the RPS19 gene in one or more cells thereby obtaining modified cells; optionally;

c) culture expanding the cells of step (b) wherein the modified cells are capable of engraftment and giving rise to progeny cells after engraftment; and d) administering to the subject the cells of step (b) or step (c) for treating the DBA in the subject.

The present invention provides for a method of treating a subject afflicted with DBA, comprising administration of a therapeutically effective amount of the modified cells, the compositions, or the compositions prepared by the methods of the present invention.

The present invention provides for a method for treating DBA in a subject with an RPS19 gene mutation relating to DBA in need thereof, the method comprising:

a) isolating HSPCs from cells obtained from the subject;

b) introducing to the cells of step (a) a composition comprising:

a CRISPR nuclease or a sequence encoding the CRISPR nuclease; and a first RNA molecule comprising a guide sequence portion having 17-25 nucleotides, wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA, optionally, introducing to the cells a donor DNA template for homology directed repair (HDR), alteration, or replacement of a target sequence of the RPS19 allele so as to modify the mutant allele of the RPS19 gene in one or more cells thereby obtaining modified cells; optionally;

c) culture expanding the cells of step (b) wherein the modified cells are capable of engraftment and giving rise to progeny cells after engraftment; and d) administering to the subject the cells of step (b) or step (c)

thereby treating the DBA in the subject.

The present invention provides for a method for treating DBA in a subject with an RPS19 gene mutation relating to DBA in need thereof, the method comprising administering to the subject autologous modified cells or progeny of autologous modified cells, wherein the autologous modified cells are modified so as to have a correction of the mutant allele of the RPS19 gene from the mutant phenotype to a non-mutant phenotype, wherein said double strand break results from introduction to the cells of a composition comprising a CRISPR nuclease or sequence encoding the CRISPR nuclease and a first RNA molecule wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA, thereby treating the DBA in the subject.

The present invention provides for an RNA molecule comprising a guide sequence portion having 17-25 contiguous nucleotides containing nucleotides in the sequence set forth in any one of SEQ ID NOs 1-20465.

The present invention provides for a composition comprising the RNA molecules of the present invention and a donor DNA template for homology directed repair (HDR), alteration, or replacement of a target sequence of the RPS19 allele.

The present invention provides for a method for modifying in a cell a mutant allele of the RPS19 gene, the method comprising delivering to the cell the RNA molecules of the present invention or the compositions of the present invention.

The present invention provides for a method for treating DBA, the method comprising delivering to a subject having DBA the RNA molecules of the present invention or the compositions of present invention, or cells modified by the RNA molecules of the present invention or the compositions of the present invention.

The present invention provides for use of the RNA molecules of the present invention, the compositions of the present invention, or the composition prepared by the methods of the present invention, for modifying in a cell a mutant RPS19 allele.

The present invention provides for a medicament comprising the RNA molecules of the present invention, the compositions of the present invention, or the composition prepared by the methods of the present invention for use in inactivating in a cell a mutant RPS19 allele, wherein the medicament is administered by delivering to the cell the RNA molecules of the present invention, the compositions of the present invention, or the composition prepared by the methods of the present invention.

The present invention provides for use of the methods of the present invention, the modified cells of the present invention, the compositions of the present invention, or the compositions prepared by the methods of the present invention, or the RNA molecules of the present invention for treating ameliorating or preventing DBA in to a subject having or at risk of having DBA.

The present invention provides for a medicament comprising the RNA molecules of the present invention, the compositions of the present invention, the compositions prepared by the methods of the present invention, or the modified cells of the present invention, for use in treating ameliorating or preventing DBA, wherein the medicament is administered by delivering to a subject having or at risk of having DBA the RNA molecules of the present invention, the compositions of the present invention, the compositions prepared by the methods of the present invention, or the modified cells of the present invention.

The present invention provides for a kit for inactivating a mutant RPS19 allele in a cell, comprising an RNA molecule of the present invention, a CRISPR nuclease or a sequence encoding the CRISPR nuclease, and/or a tracrRNA molecule or a sequence encoding the tracrRNA; and instructions for delivering the RNA molecule; CRISPR nuclease or a sequence encoding the CRISPR nuclease, and/or the tracrRNA molecule or a sequence encoding the tracrRNA to the cell to modify the mutant RPS19 allele in the cell.

The present invention provides for a kit for treating DBA in a subject, comprising an RNA molecule of the present invention, a CRISPR nuclease or a sequence encoding the CRISPR nuclease, and/or a tracrRNA molecule or a sequence encoding the tracrRNA; and instructions for delivering the RNA molecule; CRISPR nuclease or sequence encoding the CRISPR nuclease, and/or tracrRNA molecule or sequence encoding the tracrRNA to a subject having or at risk of having DBA so as to treat the DBA.

The present invention provides for a kit for inactivating a mutant RPS19 allele in a cell, comprising the compositions of the present invention, the compositions prepared by the methods of the present invention, or the modified cells of the present invention, and instructions for delivering the composition to the cell so as to modify the RPS19 gene in the cell.

The present invention provides for a kit for treating DBA in a subject, comprising the compositions of the present invention, the compositions prepared by the methods of the present invention, or the modified cells of the present invention, and instructions for delivering the compositions of the present inventions, the compositions prepared by the methods of the present invention, or the modified cells of the present invention, to a subject having or at risk of having DBA so as to treat DBA.

BRIEF DESCRIPTION OF THE DRAWINGS

FIG. 1A represents an allele specific editing approach based on targeting a nuclease (scissors accompanied by an arrow indicating the target site) to a pathogenic mutation (black box) in an exon (e.g. exon 4) of the RPS19 gene. FIG. 1B represents an allele specific editing approach based on targeting a nuclease (scissors accompanied by an arrow indicating the target site) to a heterozygous SNP (star). FIG. 1C represents a bi-allelic editing approach based on utilizing non-discriminatory guides to target a nuclease (scissors accompanied by an arrow indicating the target site) to both mutant and functional RPS19 alleles at non-coding regions within 250 basepairs of an edge of an exon bearing a pathogenic mutation position.

DETAILED DESCRIPTION

Figure 1A:
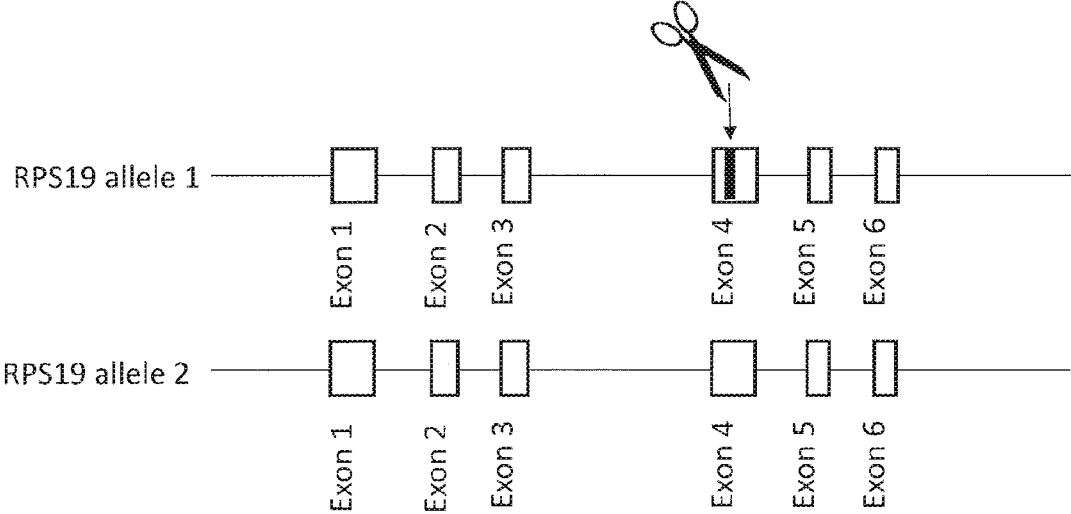
FIG. 1A-FIG. 1C: A schematic representation of the three editing strategies disclosed herein.
Figure 1B:
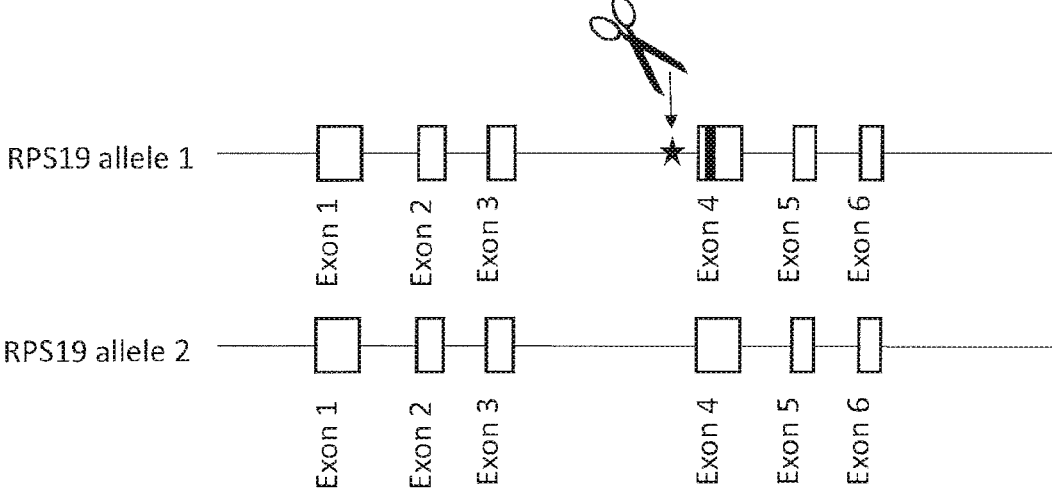
Figure 1C:
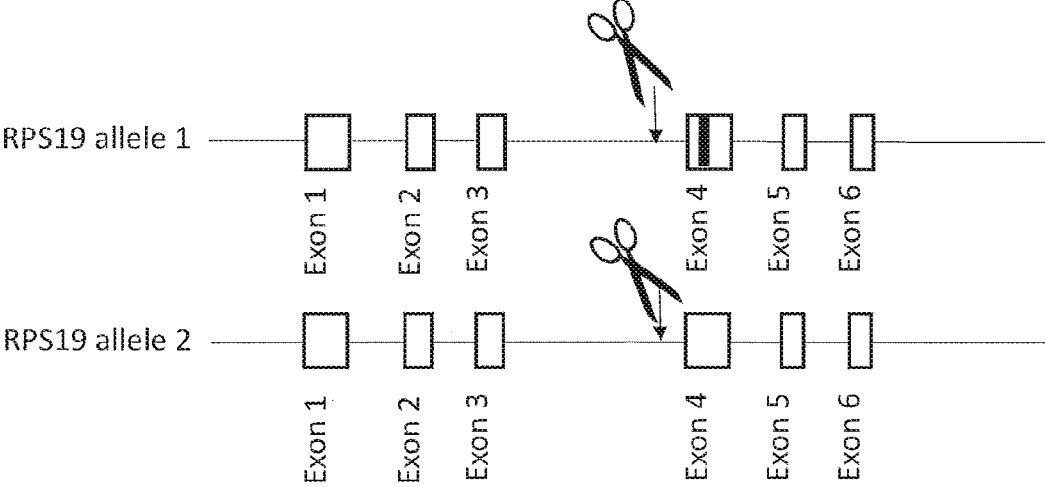

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The "guide sequence portion" of an RNA molecule refers to a nucleotide sequence that is capable of hybridizing to a specific target DNA sequence, e.g., the guide sequence portion has a nucleotide sequence which is fully complementary to the DNA sequence being targeted along the length of the guide sequence portion. In some embodiments, the guide sequence portion is 17, 18, 19, 20, 21, 22, 23, 24, or 25 nucleotides in length, or approximately 17-25, 17-24, 17-22, 17-21, 18-25, 18-24, 18-23, 18-22, 18-21, 19-25, 19-24, 19-23, 19-22, 19-21, 19-20, 20-22, 18-20, 20-21, 21-22, or 17-20 nucleotides in length. The entire length of the guide sequence portion is fully complementary to the DNA sequence being targeted along the length of the guide sequence portion. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

In embodiments of the present invention, an RNA molecule comprises a guide sequence portion having 17-25 contiguous nucleotides containing nucleotides in the sequence set forth in any one of SEQ ID NOs 1-20465. In some embodiments, the guide sequence portion have 17-25 contiguous nucleotides containing nucleotides in the sequence set forth in any one of SEQ ID NOs 1-20465. In some embodiments, the aforementioned guides are allele-specific. In some embodiments, the aforementioned guides target a SNP position. In some embodiments, the aforementioned guides target a pathogenic mutation. In some embodiments, the aforementioned guides target a non-coding region of each of the RPS19 alleles.

The term "targets" as used herein, refers to the guide sequence portion of the RNA molecule's preferential hybridization to a nucleic acid having a targeted nucleotide sequence. It is understood that the term "targets" encompasses variable hybridization efficiencies, such that there is preferential targeting of the nucleic acid having the targeted nucleotide sequence, but unintentional off-target hybridization in addition to on-target hybridization might also occur. It is understood that where an RNA molecule targets a sequence, a complex of the RNA molecule and a CRISPR nuclease molecule targets the sequence for nuclease activity.

In the context of targeting a DNA sequence that is present in a plurality of cells, it is understood that the targeting encompasses hybridization of the guide sequence portion of the RNA molecule with the sequence in one or more of the cells, and also encompasses hybridization of the RNA molecule with the target sequence in fewer than all of the cells in the plurality of cells. Accordingly, it is understood that where an RNA molecule targets a sequence in a plurality of cells, a complex of the RNA molecule and a CRISPR nuclease is understood to hybridize with the target sequence in one or more of the cells, and also may hybridize with the target sequence in fewer than all of the cells. Accordingly, it is understood that the complex of the RNA molecule and the CRISPR nuclease introduces a double strand break in relation to hybridization with the target sequence in one or more cells and may also introduce a double strand break in relation to hybridization with the target sequence in fewer than all of the cells. As used herein, the term "modified cells" refers to cells in which a double strand break is affected by a complex of an RNA molecule and the CRISPR nuclease as a result of hybridization with the target sequence, i.e. on-target hybridization. The term "modified cells" may further encompass cells in which a repair or correction of a mutation was affected following the double strand break.

As used herein, "contiguous nucleotides" set forth in a SEQ ID NO refers to nucleotides in a sequence of nucleotides in the order set forth in the SEQ ID NO without any intervening nucleotides.

The RNA molecule and or the guide sequence portion of the RNA molecule may contain modified nucleotides. Exemplary modifications to nucleotides/polynucleotides may be synthetic and encompass polynucleotides which contain nucleotides comprising bases other than the naturally occurring adenine, cytosine, thymine, uracil, or guanine bases. Modifications to polynucleotides include polynucleotides which contain synthetic, non-naturally occurring nucleosides e.g., locked nucleic acids. Modifications to polynucleotides may be utilized to increase or decrease stability of an RNA. An example of a modified polynucleotide is an mRNA containing 1-methyl pseudo-uridine. For examples of modified polynucleotides and their uses, see U.S. Pat. No. 8,278,036. PCT International Publication No. WO/2015/006747, and Weissman and Kariko, 2015, (9):1416-7, hereby incorporated by reference.

In embodiments of the present invention, the guide sequence portion may be 22 nucleotides in length and consists of 22 nucleotides in the sequence of 22 contiguous nucleotides set forth in any one of SEQ ID NOs: 1-20465 of that length. In embodiments of the present invention, the guide sequence portion may be less than 22 nucleotides in length. For example, in embodiments of the present invention the guide sequence portion may be 17, 18, 19, 20, or 21 nucleotides in length. In such embodiments the guide sequence portion may consist of 17, 18, 19, 20, or 21 nucleotides, respectively, in the sequence of 17-22 contiguous nucleotides set forth in any one of SEQ ID NOs: 1-20465. For example, a guide sequence portion having 17 nucleotides in the sequence of 17 contiguous nucleotides set forth in a presently disclosed sequence may consist of any one of the following nucleotide sequences (nucleotides excluded from the contiguous sequence are marked in strike-through):

```
                                (SEQ ID NO: 20466)
     AAACUGACACCUCAGGGACA 17 nucleotide guide sequence 1:
                                (SEQ ID NO: 20467)
     A̶A̶A̶CUGACACCUCAGGGACA 17 nucleotide guide sequence 2:
                                (SEQ ID NO: 20468)
     A̶A̶ACUGACACCUCAGGGACA 17 nucleotide guide sequence 3:
                                (SEQ ID NO: 20469)
     A̶AACUGACACCUCAGGGA C̶A̶

17 nucleotide guide sequence 4:
                                (SEQ ID NO: 20470)
     AAACUGACACCUCAGGG A̶C̶A̶
```

In embodiments of the present invention, the guide sequence portion may be greater than 20 nucleotides in length. For example, in embodiments of the present invention the guide sequence portion may be 21, 22, 23, 24, or 25 nucleotides in length. In such embodiments the guide sequence portion comprises 20, 21 or 22 nucleotides in the sequence of 20, 21, or 22 contiguous nucleotides as set forth in any one of SEQ ID NOs: 1-20465 of that length and additional nucleotides fully complimentary to a nucleotide or sequence of nucleotides adjacent to the 3' end of the target sequence, 5' end of the target sequence, or both.

In embodiments of the present invention, a CRISPR nuclease and an RNA molecule comprising a guide sequence portion form a CRISPR complex that binds to a target DNA sequence to affect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule comprising a guide sequence portion of the present invention, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek (2012) Science). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via base-pairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See U.S. Pat. No. 8,906, 616). In embodiments of the present invention, the RNA molecule may further comprise a portion having a tracr mate sequence.

According to embodiments of the present invention, an RNA molecule may be up to 500, 400, 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

A skilled artisan will appreciate that in each of the embodiments of the present invention, individually, each of the RNA molecules of the present invention are capable of complexing with a nuclease, e.g. a CRISPR nuclease, such as to associate with a target genomic DNA sequence of interest next to a protospacer adjacent motif (PAM). The nuclease then induces cleavage of target DNA to create a double-stranded break within the protospacer. Accordingly, in embodiments of the present invention, the guide sequences and RNA molecules of the present invention may target a location 1, 2, 3, 4, 5, 6, 7, 8, 9, 10, 11, 12, 13, 14, 15, 16, 17, 18, 19, 20, 21, 22, 23, 24, 25, 26, 27, or 28 nucleotides upstream or downstream from a PAM site.

Therefore, in embodiments of the present invention, the RNA molecules of the present invention in complex with a nuclease, e.g., a CRISPR nuclease, may affect a double strand break in alleles of a gene 1, 2, 3, 4, 5, 6, 7, 8, 9, 10, 11, 12, 13, 14, 15, 16, 17, 18, 19, 20, 21, 22, 23, 24, 25, 26, 27, 28 upstream or downstream from a target site.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

The term "single nucleotide polymorphism (SNP) position", as used herein, refers to a position in which a single nucleotide DNA sequence variation occurs between members of a species, or between paired chromosomes in an individual. In the case that a SNP position exists at paired chromosomes in an individual, a SNP on one of the chromosomes is a "heterozygous SNP." The term SNP position refers to the particular nucleic acid position where a specific variation occurs and encompasses both a sequence including the variation from the most frequently occurring base at the particular nucleic acid position (also referred to as "SNP" or alternative "ALT") and a sequence including the most frequently occurring base at the particular nucleic acid position (also referred to as reference, or "REF"). Accordingly, the sequence of a SNP position may reflect a SNP (i.e. an alternative sequence variant relative to a consensus reference sequence within a population), or the reference sequence itself.

"Eukaryotic" cells include, but are not limited to, fungal cells (such as yeast), plant cells, animal cells, mammalian cells and human cells.

As used herein, the term "HSPC" refers to both hematopoietic stem cells and hematopoietic stem progenitor cells. Non-limiting examples of stem cells include a bone marrow cell, a myeloid progenitor cell, a multipotent progenitor cell, a lineage restricted progenitor cell.

As used herein, "progenitor cell" refers to a lineage cell that is derived from stem cell and retains mitotic capacity and multipotency (e.g., can differentiate or develop into more than one but not all types of mature lineage of cell). As used herein "hematopoiesis" or "haemopoiesis" refers to the formation and development of various types of blood cells (e.g., red blood cells, megakaryocytes, myeloid cells (e.g., monocytes, macrophages and neutrophil), and lymphocytes) and other formed elements in the body (e.g., in the bone marrow).

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

The term "homology-directed repair" or "HDR" refers to a mechanism for repairing DNA damage in cells, for example, during repair of double-stranded and single-stranded breaks in DNA. HDR requires nucleotide sequence homology and uses a "nucleic acid template" (nucleic acid template or donor template used interchangeably herein) to repair the sequence where the double-strand or single strand break occurred (e.g., DNA target sequence). This results in the transfer of genetic information from, for example, the nucleic acid template to the DNA target sequence. HDR may result in alteration of the DNA target sequence (e.g., insertion, deletion, mutation) if the nucleic acid template sequence differs from the DNA target sequence and part or all of the nucleic acid template polynucleotide or oligonucleotide is incorporated into the DNA target sequence. In some embodiments, an entire nucleic acid template polynucleotide, a portion of the nucleic acid template polynucleotide, or a copy of the nucleic acid template is integrated at the site of the DNA target sequence. DNA repair pathways, including but not limited to HDR, play a role in targeted genome modification, which is a powerful tool that can be used to reverse the effect of pathogenic genetic variations and therefore has the potential to provide new therapies for human genetic diseases. Current genome engineering tools, including engineered zinc finger nucleases (ZFNs), transcription activator-like effector nucleases (TALENs), and most recently, RNA-guided DNA endonucleases such as CRISPR/Cas, produce sequence-specific DNA breaks in a genome. The modification of the genomic sequence occurs at the next step and is the product of the activity cellular DNA repair mechanisms triggered in response to the newly formed DNA break. These mechanisms include, for example: (1) classical non-homologous end-joining (NHEJ) in which the two ends of the break are ligated together in a fast but also inaccurate manner (i.e. frequently resulting in mutation of the DNA at the cleavage site in the form of small insertion or deletions) and (2) homology-directed repair (HDR) in which an intact homologous DNA donor is used to replace the DNA surrounding the cleavage site in an accurate manner. In addition and as discussed above, HDR can also mediate the precise insertion of external or endogenous DNA at the break site.

The terms "nucleic acid template" and "donor", refer to a nucleotide sequence that is inserted or copied into a genome. The nucleic acid template comprises a nucleotide sequence, e.g., of one or more nucleotides, that will be added to or will template a change in the target nucleic acid or may be used to modify the target sequence. A nucleic acid template sequence may be of any length, for example between 2 and 10,000 nucleotides in length (or any integer value there between or there above), preferably between about 100 and 1,000 nucleotides in length (or any integer there between), more preferably between about 200 and 500 nucleotides in length. A nucleic acid template may be a single stranded nucleic acid, a double stranded nucleic acid. In some embodiment, the nucleic acid template comprises a nucleotide sequence, e.g., of one or more nucleotides, that corresponds to wild type sequence of the target nucleic acid, e.g., of the target position. In some embodiments, the nucleic acid template comprises a ribonucleotide sequence, e.g., of one or more ribonucleotides, that corresponds to wild type sequence of the target nucleic acid, e.g., of the target position. In some embodiment, the nucleic acid template comprises modified ribonucleotides.

Insertion of an exogenous sequence (also called a "donor sequence," donor template" or "donor"), for example, for correction of a mutant gene or for increased expression of a wild-type gene can also be carried out. It will be readily apparent that the donor sequence is typically not identical to the genomic sequence where it is placed. A donor sequence can contain a non-homologous sequence flanked by two regions of homology to allow for efficient HDR at the location of interest. Additionally, donor sequences can comprise a vector molecule containing sequences that are not homologous to the region of interest in cellular chromatin. A donor molecule can contain several, discontinuous regions of homology to cellular chromatin. For example, for targeted insertion of sequences not normally present in a region of interest, said sequences can be present in a donor nucleic acid molecule and flanked by regions of homology to sequence in the region of interest.

The donor polynucleotide can be DNA or RNA, single-stranded and/or double-stranded and can be introduced into a cell in linear or circular form. See, e.g., U.S. Patent Publication Nos. 2010/0047805; 2011/0281361; 2011/0207221; and 2019/0330620A1. As disclosed in U.S. Publication No. 2019/0330620A1, donor sequence may be encoded on the same molecule as a guide RNA sequence. See Anzolne et al. (2019) Nature 576:149-157. If introduced in linear form, the ends of the donor sequence can be protected (e.g., from exonucleolytic degradation) by methods known to those of skill in the art. For example, one or more dideoxynucleotide residues are added to the 3' terminus of a linear molecule and/or self-complementary oligonucleotides are ligated to one or both ends. See, for example, Chang et al. (1987) Proc. Natl. Acad. Sci. USA 84:4959-4963; Nehls et al. (1996) Science 272:886-889. Additional methods for protecting exogenous polynucleotides from degradation include, but are not limited to, addition of terminal amino group(s) and the use of modified internucleotide linkages such as, for example, phosphorothioates, phosphoramidates, and O-methyl ribose or deoxyribose residues.

A donor sequence may also be an oligonucleotide and be used for gene correction or targeted alteration of an endogenous sequence. The oligonucleotide may be introduced to the cell on a vector, may be electroporated into the cell, or may be introduced via other methods known in the art. The oligonucleotide can be used to 'correct' a mutated sequence in an endogenous gene (e.g., the sickle mutation in beta globin), or may be used to insert sequences with a desired purpose into an endogenous locus.

A polynucleotide can be introduced into a cell as part of a vector molecule having additional sequences such as, for example, replication origins, promoters and genes encoding antibiotic resistance. Moreover, donor polynucleotides can be introduced as naked nucleic acid, as nucleic acid complexed with an agent such as a liposome or poloxamer, or can be delivered by viruses (e.g., adenovirus, AAV, herpesvirus, retrovirus, lentivirus and integrase defective lentivirus (IDLV)).

The donor may be inserted so that its expression is driven by the endogenous promoter at the integration site, namely the promoter that drives expression of the endogenous gene into which the donor is inserted. However, it will be apparent that the donor may comprise a promoter and/or enhancer, for example a constitutive promoter or an inducible or tissue specific promoter.

The donor molecule may be inserted into an endogenous gene such that all, some or none of the endogenous gene is expressed. For example, a transgene as described herein may be inserted into an endogenous locus such that some (N-terminal and/or C-terminal to the transgene) or none of the endogenous sequences are expressed, for example as a fusion with the transgene. In other embodiments, the transgene (e.g., with or without additional coding sequences such as for the endogenous gene) is integrated into any endogenous locus, for example a safe-harbor locus, for example a CCR5 gene, a CXCR4 gene, a PPP1R12c (also known as AAVS1) gene, an albumin gene or a Rosa gene. See, e.g., U.S. Pat. Nos. 7,951,925 and 8,110,379; U.S. Publication Nos. 20080159996; 201000218264; 20100291048; 20120017290; 20110265198; 20130137104; 20130122591; 20130177983 and 20130177960 and U.S. Provisional Application No. 61/823,689).

When endogenous sequences (endogenous or part of the transgene) are expressed with the transgene, the endogenous sequences may be full-length sequences (wild-type or mutant) or partial sequences. Preferably the endogenous sequences are functional. Non-limiting examples of the function of these full length or partial sequences include increasing the serum half-life of the polypeptide expressed by the transgene (e.g., therapeutic gene) and/or acting as a carrier.

Furthermore, although not required for expression, exogenous sequences may also include transcriptional or translational regulatory sequences, for example, promoters, enhancers, insulators, internal ribosome entry sites, sequences encoding 2A peptides and/or polyadenylation signals.

In certain embodiments, the donor molecule comprises a sequence selected from the group consisting of a gene encoding a protein (e.g., a coding sequence encoding a protein that is lacking in the cell or in the individual, or a portion thereof, or an alternate version of a gene encoding a protein, or a portion thereof), a regulatory sequence and/or a sequence that encodes a structural nucleic acid such as a microRNA or siRNA.

One aspect of the present disclosure provides a method for utilizing a guide sequence to target a CRISPR nuclease to affect a DSB to modify an allele of a gene bearing a disease associated mutation ('mutant allele'). In some embodiments, at least one naturally occurring nucleotide difference or polymorphism (e.g., single nucleotide polymorphism (SNP)) and/or a disease associated mutation is utilized for targeting one of two alleles of a gene which is an allele bearing a mutation causing a disease phenotype ('mutant allele') rather than a functional/wildtype allele. In some embodiments, a SNP position is utilized for distinguishing/discriminating between two alleles of a gene, an allele bearing a disease associated mutation and a particular sequence (SNP/REF) in the SNP position, and a functional/wild type allele bearing a different sequence in the SNP position. In some embodiments, a disease associated mutation is utilized for distinguishing/discriminating between two alleles of a gene, an allele bearing the disease associated mutation, and a wildtype mutant allele not bearing the same disease associated mutation or bearing a different disease associated mutation. In other embodiments, a non-coding region of the gene common to both the mutant allele and the functional allele is targeted. In some embodiments, the method is for treating, ameliorating, or preventing a dominant haploinsufficiency genetic disorder. In some embodiments, the method further comprises the step of allele cleavage by a CRISPR nuclease. The allele cleavage is selected from the group consisting of: a double strand break (DSB) and a single strand break. In some embodiments, the allele cleavage is a DSB. In some embodiments, the method further comprises the step of correction of the allele such that the corrected allele results in an expression of a functional protein. In some embodiments, the correction is performed by homology directed repair (HDR). In some embodiments, the method further comprises the step of editing/correcting/modifying a sequence of the mutant allele such as to allow expression of a functional protein. In some embodiments, the method further comprises the step of editing/correcting/modifying sequences of the two alleles such as to allow expression of a functional protein.

According to embodiments of the present invention, there is provided a method for modifying in a cell a mutant allele of the Ribosomal Protein S19 (RPS19) having a mutation associated with Diamond Blackfan anemia (DBA), the method comprising introducing to the cell a composition comprising:

a CRISPR nuclease or a sequence encoding the CRISPR nuclease; and a first RNA molecule comprising a guide sequence portion having 17-25 nucleotides or a nucleotide sequence encoding the same, wherein a complex of the CRISPR nuclease and the first RNA molecule affects a double strand break in the mutant allele of the RPS19 gene.

In some embodiments, the first RNA molecule targets the CRISPR nuclease to the mutation associated with DBA.

In some embodiments, the mutation associated with DBA is any one of 19:41859951_T_C; 19:41860011_C_T; 19:41860139_G_T; 19:41860151_C_T; 19:41860216_C_T; 19:41860280_A_G; 19:41860303_C_T; 19:41860766_C_A; 19:41860768_C_T; 19:41860777_G_T; 19:41860817_G_T; 19:41860823_G_C; 19:41860842_A_G; 19:41860853_TG_T; 19:41861111_G_A; 19:41861138_G_A; 19:41861144_A_AT; 19:41861166_CAA_C; 19:41861179_C_T; 19:41861204_C_T; 19:41861217_G_C; 19:41869029_A_G: 19:41869033_TC_CT; 19:41869036_A_C; 19:41869042_C_T; 19:41869043_G_A; 19:41869066_G_A; 19:41869108_A_T; 19:41869138_C_T; 19:41869140_A_AGG: 19:41869151_GTGTG_GTGTGTG: 19:41869152 TTTG; 19:41869162_CG_C; 19:41869166_T_A; 19:41869192_A_ATGG; 19:41869217_A_C: 19:41869708_A_ACT; 19:41869722_G_A: 19:41869724_CAA_C; 19:41869724_C_T; 19:41869748_G_T: 19:41869752_A_G; or 19:41869755_T_C.

In some embodiments, the guide sequence portion of the first RNA molecule comprises a guide sequence of 17-25 contiguous nucleotides containing nucleotides in the sequence set forth in any one of SEQ ID NOs 1-20465 which targets a mutation associated with DBA.

In some embodiments, the first RNA molecule targets the CRISPR nuclease to a SNP position of the mutant allele.

In some embodiments, the SNP position is in anon-coding region of the RPS19 gene at a location that is 250 or fewer nucleotides from the first or the last nucleotide of a coding region of the RPS19 gene containing the mutation associated with DBA.

In some embodiments, the SNP position is located at any one of 19:41860325_C_T; 19:41869228_A_G; 19:41869823_T_C, rs1385169206; rs2075749; rs2075750; or rs2075754.

In some embodiments, the guide sequence portion of the first RNA molecule comprises a guide sequence having 17-25 contiguous nucleotides containing nucleotides in the sequence set forth in any one of SEQ ID NOs 1-20465 which targets a sequence in a SNP position of the mutant allele.

In some embodiments, the SNP position contains a heterozygous SNP.

According to embodiments of the present invention, the RNA molecule targets a particular sequence (SNP/REF) in a SNP position or a disease-causing mutation of a mutant allele.

In some embodiments, the SNP position is in a promoter region, the start codon, an untranslated region (UTR), an intron, an exon, a downstream sequence of a mutant allele. Each possibility represents a separate embodiment. In some embodiments, the SNP position is in a distance of less than 2000 nucleotides, 15000 nucleotides, 1000 nucleotides, 750 nucleotides, 500 nucleotides, 400 nucleotides, 300 nucleotides, 250 nucleotides, 200 nucleotides, 150 nucleotides, or 50 nucleotides from the disease-associated mutation. Each possibility represents a separate embodiment.

In some embodiments, a complex of the CRISPR nuclease and the first RNA molecule affects a double strand break in a non-coding region common to both alleles of the RPS19 gene at a location that is 500, 450, 400, 350, 300, 250 or fewer nucleotides from the first or the last nucleotide of a coding region of the RPS19 gene containing the mutation associated with DBA. Each possibility represents a separate embodiment.

In some embodiments, the non-coding region is upstream of exon 1, upstream of exon 2, upstream of exon 3, upstream of exon 4, upstream of exon 5, upstream of exon 6, downstream of exon 1, downstream of exon 2, downstream of exon 3, downstream of exon 4, downstream of exon 5, or downstream of exon 6.

In some embodiments, the guide sequence portion of the first RNA molecule comprises 17-25 contiguous nucleotides containing nucleotides in the sequence set forth in any one of SEQ ID NOs 1-20465 which targets a non-coding region of the RPS19 gene.

In some embodiments, further comprising introduction of a donor DNA template for homology directed repair (HDR), alteration, or replacement of a desired sequence of the RPS19 allele. Accordingly, this method of modifying a RPS19 pathogenic mutation via HDR corrects the dominant haploinsufficiency disorder that manifests as DBA.

In embodiments of the present invention, the target sequence is in the coding region bearing the mutation associated with DBA or is the entire coding region bearing the mutation associated with DBA.

In embodiments of the present invention, the modifying results in correction of the mutant allele of the RPS19 gene from the mutant phenotype to a non-mutant phenotype.

Embodiments of the present invention further comprise obtaining the cell with an RPS19 gene mutation associated with DBA from a subject with an RPS19 gene mutation related to DBA and/or suffering from DBA.

Embodiments of the present invention further comprise first selecting a subject with an RPS19 gene mutation related to DBA and/or suffering from DBA.

Embodiments of the present invention further comprise obtaining the cell from the subject by mobilization and/or by apheresis.

Embodiments of the present invention further comprise obtaining the cell from the subject by bone marrow aspiration.

In embodiments of the present invention, the cell is prestimulated prior to introducing the composition to the cell.

Embodiments of the present invention further comprise culture expanding the cell to obtain cells.

In embodiments of the present invention, the cells are cultured with one or more of stem cell factor (SCF), IL-3, and GM-CSF.

In embodiments of the present invention, the cells are cultured with at least one cytokine.

In embodiments of the present invention, the at least one cytokine is a recombinant human cytokine.

In embodiments of the present invention, the cell is among a plurality of cells, wherein the composition comprising the first RNA molecule and/or donor DNA template is introduced into at least the cell as well as other cells among the plurality of cells, and the mutant allele of the RPS19 gene is modified in at least the cell as well as in the other cells among the plurality of cells, thereby obtaining multiple modified cells.

In embodiments of the present invention, introducing the composition comprising the first RNA molecule and/or introduction of the donor DNA template comprises electroporation of the cell or cells.

The present invention provides for a modified cell obtained by the methods of the present invention.

The present invention provides for modified cells obtained from culture expanding the modified cell obtained by the methods of the present invention.

In embodiments of the present invention, the modified cell or cells are capable of engraftment.

In embodiments of the present invention, the modified cell or cells are capable of giving rise to progeny cells.

In embodiments of the present invention, the modified cell or cells are capable of giving rise to progeny cells after engraftment.

In embodiments of the present invention, the modified cell or cells are capable of giving rise to progeny cells after an autologous engraftment.

In embodiments of the present invention, the modified cell or cells are capable of giving rise to progeny cells for at least 12 months or at least 24 months after engraftment.

In embodiments of the present invention, the modified cell or cells are hematopoietic stem cells and/or progenitor cells (HSPCs).

In embodiments of the present invention, the modified cell or cells are CD34+ hematopoietic stem cells.

In embodiments of the present invention, the modified cell or cells are bone marrow cells or peripheral mononucleated cells (PMCs).

The present invention provides for a composition comprising the modified cells of the present invention and a pharmaceutically acceptable carrier.

In embodiments of the present invention, an in vitro or ex vivo method of preparing the compositions of the present invention, comprising mixing the cells with the pharmaceutically acceptable carrier.

The present invention provides for a method of preparing in vitro or ex vivo a composition comprising modified cells, the method comprising:
a) isolating HSPCs from cells obtained from a subject with an RPS19 gene mutation related to DBA and/or suffering from DBA, and obtaining the cell from the subject;
b) introducing to the cells of step (a) a composition comprising:
a CRISPR nuclease or a sequence encoding the CRISPR nuclease; and
a first RNA molecule comprising a guide sequence portion having 17-25 nucleotides,
wherein a complex of the CRISPR nuclease and the first RNA molecule affects a double strand break in the mutant allele of the RPS19 gene according to any one of the methods of the invention,
optionally, introducing to the cells a donor DNA template for homology directed repair (HDR), alteration, or replacement of a target sequence of the RPS19 allele
so as to modify the mutant allele of the RPS19 gene in one or more cells thereby obtaining modified cells; optionally
c) culture expanding the modified cells of step (b), wherein the modified cells are capable of engraftment and giving rise to progeny cells after engraftment.

The present invention provides for use of a composition prepared in vitro by a method comprising:
a) isolating HSPCs from cells obtained from a subject with an RPS19 gene mutation related to DBA and/or suffering from DBA, and obtaining the cell from the subject;
b) introducing to the cells of step (a) a composition comprising:
a CRISPR nuclease or a sequence encoding the CRISPR nuclease; and
a first RNA molecule comprising a guide sequence portion having 17-25 nucleotides,
wherein a complex of the CRISPR nuclease and the first RNA molecule affects a double strand break in the mutant allele of the RPS19 gene according to any one of the methods of the invention,
optionally, introducing to the cells a donor DNA template for homology directed repair (HDR), alteration, or replacement of a target sequence of the RPS19 allele
so as to modify the mutant allele of the RPS19 gene in one or more cells thereby obtaining modified cells; optionally;
c) culture expanding the cells of step (b) wherein the modified cells are capable of engraftment and giving rise to progeny cells after engraftment; and
d) administering to the subject the cells of step (b) or step (c)
for treating the DBA in the subject.

The present invention provides for a method of treating a subject afflicted with DBA, comprising administration of a therapeutically effective amount of the modified cells of the present invention, the compositions of the present invention, or the composition prepared by the methods of the present invention.

The present invention provides for a method for treating DBA in a subject with an RPS19 gene mutation relating to DBA in need thereof, the method comprising:
a) isolating HSPCs from cells obtained from the subject;
b) introducing to the cells of step (a) a composition comprising:
a CRISPR nuclease or a sequence encoding the CRISPR nuclease; and
a first RNA molecule comprising a guide sequence portion having 17-25 nucleotides,
wherein a complex of the CRISPR nuclease and the first RNA molecule affects a double strand break in the mutant allele of the RPS19 gene according to any one of the methods of the invention,
optionally, introducing to the cells a donor DNA template for homology directed repair (HDR), alteration, or replacement of a target sequence of the RPS19 allele
so as to modify the mutant allele of the RPS19 gene in one or more cells thereby obtaining modified cells; optionally;
c) culture expanding the cells of step (b) wherein the modified cells are capable of engraftment and giving rise to progeny cells after engraftment; and
d) administering to the subject the cells of step (b) or step (c)
thereby treating the DBA in the subject.

The present invention provides for a method for treating DBA in a subject with an RPS19 gene mutation relating to DBA in need thereof, the method comprising
administering to the subject autologous modified cells or progeny of autologous modified cells, wherein the autologous modified cells are modified so as to have a correction of the mutant allele of the RPS19 gene from the mutant phenotype to a non-mutant phenotype, wherein said double strand break results from introduction to the cells of a composition comprising a CRISPR nuclease or sequence encoding the CRISPR nuclease and a first RNA molecule wherein a complex of the CRISPR nuclease and the first RNA molecule affects a double strand break in the mutant allele of the RPS19 gene according to any one of the methods of the invention, thereby treating the DBA in the subject.

The present invention provides for an RNA molecule comprising a guide sequence portion having 17-25 contiguous nucleotides containing nucleotides in the sequence set forth in any one of SEQ ID NOs 1-20465.

In embodiments of the present invention, the RNA molecule further comprises a portion having a sequence which binds to a CRISPR nuclease.

In embodiments of the present invention, the sequence which binds to a CRISPR nuclease is a tracrRNA sequence.

In embodiments of the present invention, the RNA molecule further comprises one or more linker portions.

In embodiments of the present invention, the RNA molecule further comprises a portion having a tracr mate sequence.

In embodiments of the present invention, the RNA molecule is up to 300 nucleotides in length.

According to embodiments of the present invention, the RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 30 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

The present invention provides for a composition comprising the RNA molecules of the present invention and a donor DNA template for homology directed repair (HDR), alteration, or replacement of a target sequence of the RPS19 allele.

In embodiments of the present invention, the composition further comprises one or more CRISPR nucleases or sequences encoding the one or more CRISPR nucleases, and/or one or more tracrRNA molecules or sequences encoding the one or more tracrRNA molecules.

The present invention provides for a method for modifying in a cell a mutant allele of the RPS19 gene, the method comprising delivering to the cell the RNA molecules of the present invention or the compositions of the present invention.

The present invention provides for a method for treating DBA, the method comprising delivering to a subject having DBA the RNA molecules of the present invention or the compositions of the present invention, or cells modified by the RNA molecules of the present invention or the compositions of the present invention.

In embodiments of the present invention, the one or more CRISPR nucleases and/or the tracrRNA and the RNA molecule are delivered to the subject and/or cells substantially at the same time or at different times.

In embodiments of the present invention, the modifying or treating results in a functional protein encoded by both alleles of the RPS19 gene.

The present invention provides for use of the RNA molecules of the present invention, the compositions of the present invention, or the composition prepared by the methods of the present invention, for modifying in a cell a mutant RPS19 allele.

The present invention provides for a medicament comprising the RNA molecules of the present invention, the compositions of the present invention, or the composition prepared by the methods of the present invention for use in inactivating in a cell a mutant RPS19 allele, wherein the medicament is administered by delivering to the cell the RNA molecules of the present invention, the compositions of the present invention, or the composition prepared by the methods of the present invention.

The present invention provides for use of the methods of the present invention, the modified cells of the present invention, the compositions of the present invention, or the compositions prepared by the methods of the present invention, or the RNA molecules of the present invention for treating ameliorating or preventing DBA in to a subject having or at risk of having DBA.

The present invention provides for a medicament comprising the RNA molecules of the present invention, the compositions of the present invention, the compositions prepared by the methods of the present invention, or the modified cells of the present invention, for use in treating ameliorating or preventing DBA, wherein the medicament is administered by delivering to a subject having or at risk of having DBA the RNA molecules of the present invention, the compositions of the present invention, the compositions prepared by the methods of the present invention, or the modified cells of the present invention.

The present invention provides for a kit for inactivating a mutant RPS19 allele in a cell, comprising an RNA molecule of the present invention, a CRISPR nuclease or a sequence encoding the CRISPR nuclease, and/or a tracrRNA molecule or a sequence encoding the tracrRNA; and instructions for delivering the RNA molecule; CRISPR nuclease or a sequence encoding the CRISPR nuclease, and/or the tracrRNA molecule or a sequence encoding the tracrRNA to the cell to modify the mutant RPS19 allele in the cell.

The present invention provides for a kit for treating DBA in a subject, comprising an RNA molecule of the present invention, a CRISPR nuclease or a sequence encoding the CRISPR nuclease, and/or a tracrRNA molecule or a sequence encoding the tracrRNA; and instructions for delivering the RNA molecule; CRISPR nuclease or sequence encoding the CRISPR nuclease, and/or tracrRNA molecule or sequence encoding the tracrRNA to a subject having or at risk of having DBA so as to treat the DBA.

The present invention provides for a kit for inactivating a mutant RPS19 allele in a cell, comprising the compositions of the present invention, the compositions prepared by the methods of the present invention, or the modified cells of the present invention, and instructions for delivering the composition to the cell so as to modify the RPS19 gene in the cell.

The present invention provides for a kit for treating DBA in a subject, comprising the compositions of the present invention, the compositions prepared by the methods of the present invention, or the modified cells of the present invention, and instructions for delivering the compositions of the present inventions, the compositions prepared by the methods of the present invention, or the modified cells of the present invention, to a subject having or at risk of having DBA so as to treat DBA.

According to some embodiments of the present invention, there is provided a kit for repairing/correcting/modifying a mutant DBA allele in a cell(s), comprising an RNA molecule comprising a guide sequence portion having 17-25 contiguous nucleotides containing nucleotides in the sequence set forth in any one of SEQ ID NOs 1-20465, a CRISPR nuclease, and/or a tracrRNA molecule; and instructions for delivering the RNA molecule; CRISPR nuclease, and/or the tracrRNA to the cell. In some embodiments, the kit further comprises, a nucleic acid template for homology-directed repair, alteration, or replacement of at least a portion of a target gene.

According to some embodiments of the present invention, there is provided a kit for treating DBA in a subject, comprising an RNA molecule comprising a guide sequence portion having 17-25 contiguous nucleotides containing nucleotides in the sequence set forth in any one of SEQ ID NOs 1-20465, a CRISPR nuclease, and/or a tracrRNA molecule; and instructions for delivering the RNA molecule; CRISPR nuclease, and/or the tracrRNA to a subject having or at risk of having DBA. In some embodiments, the kit further comprises, a nucleic acid template for homology-directed repair, alteration, or replacement of at least a portion of a target gene.

The present invention provides for a method for selecting a subject for treatment of DBA from a pool of subjects diagnosed with DBA, comprising the steps of:
  a) obtaining cells from each subject in the pool of subjects;
  b) screening each subjects cells for an RPS19 gene mutation related to DBA and selecting only subjects with an RPS19 gene mutation related to DBA;
  c) screening by sequencing the cells of subjects selected in step (b) for heterozygosity at one or more polymorphic sites selected from the group consisting of 19:41860325_C_T; 19:41869228_A_G; 19:41869823_T_C, rs1385169206; rs2075749; rs2075750; and rs2075754; and
  d) selecting for treatment only subjects with cells that are heterozygous at the one or of the more polymorphic sites.

The present invention provides for a method for selecting a subject for treatment of DBA from a pool of subjects diagnosed with DBA, comprising the steps of:
  a) obtaining cells from each subject in the pool of subjects; and
  b) screening each subject's cells for an RPS19 gene mutation related to DBA and selecting only subjects with an RPS19 gene mutation related to DBA.
  c) According to some embodiments of the present invention, there is provided a method for treating DBA, the method comprising delivering to a subject or cell(s) obtained from a subject having DBA or at risk of DBA a composition comprising an RNA molecule comprising a guide sequence portion having 17-25 contiguous nucleotides containing nucleotides in the sequence set forth in any one of SEQ ID NOs 1-20465 and a CRISPR nuclease.

According to embodiments of the present invention, there is provided a medicament comprising an RNA molecule comprising a guide sequence portion having 17-25 contiguous nucleotides containing nucleotides in the sequence set forth in any one of SEQ ID NOs 1-20465 and a CRISPR nuclease for use in repairing/correcting/modifying a mutant RPS19 allele in a cell, wherein the medicament is administered by delivering to the cell the composition comprising an RNA molecule comprising a guide sequence portion having 17-25 contiguous nucleotides containing nucleotides in the sequence set forth in any one of SEQ ID NOs 1-20465 and a CRISPR nuclease.

According to some embodiments of the present invention, there is provided use of a composition comprising an RNA molecule comprising a guide sequence portion having 17-25 contiguous nucleotides containing nucleotides in the sequence set forth in any one of SEQ ID NOs 1-20465 and a CRISPR nuclease for treating ameliorating or preventing DBA, comprising delivering to a subject having or at risk of having DBA the composition of comprising an RNA molecule comprising a guide sequence portion having 17-25 contiguous nucleotides containing nucleotides in the sequence set forth in any one of SEQ ID NOs 1-20465 and a CRISPR nuclease.

According to some embodiments of the present invention, there is provided a medicament comprising the composition comprising an RNA molecule comprising a guide sequence portion having 17-25 contiguous nucleotides containing nucleotides in the sequence set forth in any one of SEQ ID NOs 1-20465 and a CRISPR nuclease for use in treating ameliorating or preventing DBA, wherein the medicament is administered by delivering to a subject having or at risk of having DBA: the composition comprising an RNA molecule comprising a guide sequence portion having 17-25 contiguous nucleotides containing nucleotides in the sequence set forth in any one of SEQ ID NOs 1-20465 and a CRISPR nuclease. In some embodiments, the medicament further comprises, a nucleic acid template for homology-directed repair, alteration, or replacement of at least a portion of a target gene.

The compositions and methods of the present disclosure may be utilized for treating, preventing, ameliorating, or slowing progression of DBA.

In some embodiments, the method of repairing/correcting a mutant allele further comprises enhancing activity of the functional protein such as by providing a protein/peptide, a nucleic acid encoding a protein/peptide, or a small molecule such as a chemical compound, capable of activating/enhancing activity of the functional protein.

In embodiments of the present invention, the guide sequence portion of the first RNA molecule comprises 17-25 contiguous nucleotides containing nucleotides in the sequence set forth in any one of SEQ ID NOs 1-20465.

According to some embodiments of the present invention, there is provided a composition comprising an RNA molecule comprising a guide sequence portion having 17-25 contiguous nucleotides containing nucleotides in the sequence set forth in any one of SEQ ID NOs 1-20465 and a CRISPR nuclease.

According to embodiments of the present invention, the composition may comprise a nucleic acid template for homology-directed repair, alteration, or replacement of a target DNA sequence comprising the pathogenic mutation (e.g., an allele bearing a disease-associated mutation, or an allele bearing a disease-associated mutation and a particular sequence SNP/REF in the SNP position).

According to some embodiments of the present invention, there is provided a method for repairing/correcting a mutant RPS19 allele in a cell, the method comprising delivering to the cell a composition comprising an RNA molecule comprising a guide sequence portion having 17-25 contiguous nucleotides containing nucleotides in the sequence set forth in any one of SEQ ID NOs 1-20465 and a CRISPR nuclease.

In anon-limiting example, an RNA molecule comprising a guide sequence is utilized to direct a CRISPR nuclease to a mutant allele and create a double-strand break (DSB) and correction/repair of the mutant allele is further performed, such as by utilizing homology directed repair (HDR), which incorporates a homologous strand as a repair template.

According to embodiments of the present invention, the CRISPR nuclease and the RNA molecule or RNA molecules are delivered to the subject and/or cells obtained from the subject substantially at the same time or at different times.

According to embodiments of the present invention, the tracrRNA is delivered to the subject and/or cells obtained from the subject substantially at the same time or at different times as the CRISPR nuclease and RNA molecule or RNA molecules.

According to embodiments of the present invention, the nucleic acid template is delivered to the subject and/or cells obtained from the subject substantially at the same time or at different times as the CRISPR nuclease and RNA molecule or RNA molecules.

In some embodiments, there is provided a method comprising removing an exon containing a disease-causing mutation from a mutant allele, wherein the RNA molecule or a first and a second RNA molecules target regions flanking an entire exon or a portion of the exon or multiple exons or the entire open reading frame of a gene, or the entire gene. In some embodiments, the method includes exon skipping. In some embodiments, the method further comprises, utilizing a nucleic acid template for homology-directed repair, alteration, or replacement of the entire exon or a portion of the exon or multiple exons or the entire open reading frame of a gene, or the entire gene. Alternatively, repair of the mutant allele sequence is template free.

According to embodiments of the present invention, the method comprises subjecting the mutant allele to error prone non-homologous end joining (NHEJ) mechanism. According to preferred embodiments of the present invention, the method comprises correction or repair of a mutant allele with a template via a homology-directed repair mechanism after a targeted double-strand break in order to remove the haploinsufficiency manifestations of the mutant allele.

According to some embodiments of the present invention, there is provided use of a composition comprising an RNA molecule comprising a guide sequence portion having 17-25 contiguous nucleotides containing nucleotides in the sequence set forth in any one of SEQ ID NOs 1-20465 and a CRISPR nuclease repairing/correcting/modifying a mutant RPS19 allele in a cell, comprising delivering to the cell the RNA molecule comprising a guide sequence portion having 17-25 contiguous nucleotides containing nucleotides in the sequence set forth in any one of SEQ ID NOs 1-20465 and the CRISPR nuclease.

In embodiments of the present invention, the RNA molecule comprises a guide sequence portion having 17-25 contiguous nucleotides containing nucleotides in the sequence set forth in any one of SEQ ID NOs 1-20465.

One aspect of the present invention also provides for a method for modifying in a cell a mutant allele of the Ribosomal Protein S19 gene (RPS19 gene) having a mutation associated with Diamond Blackfan anemia (DBA), the method comprising
   introducing to the cell a composition comprising:
      a CRISPR nuclease or a sequence encoding the CRISPR nuclease; and
      a first RNA molecule comprising a guide sequence portion having 17-25 nucleotides or a nucleotide sequence encoding the same,
   wherein a complex of the CRISPR nuclease and the first RNA molecule affects a double strand break in a non-coding region of the RPS19 gene at a location that is 250 or fewer nucleotides from the first or the last nucleotide of a coding region of the RPS19 gene containing the mutation associated with DBA.

One aspect of the present invention also provides for a method for modifying in a cell a mutant allele of the Ribosomal Protein S19 gene (RPS19 gene) having a mutation associated with Diamond Blackfan anemia (DBA), the method comprising
   introducing to the cell a composition comprising:
      a CRISPR nuclease or a sequence encoding the CRISPR nuclease; and
      a first RNA molecule comprising a guide sequence portion having 17-25 nucleotides or a nucleotide sequence encoding the same,
   wherein a complex of the CRISPR nuclease and the first RNA molecule targets the CRISPR nuclease to the mutation associated with DBA.

One aspect of the present invention also provides for a method for modifying in a cell a mutant allele of the Ribosomal Protein S19 gene (RPS19 gene) having a mutation associated with Diamond Blackfan anemia (DBA), the method comprising
   introducing to the cell a composition comprising:
      a CRISPR nuclease or a sequence encoding the CRISPR nuclease; and
      a first RNA molecule comprising a guide sequence portion having 17-25 nucleotides or a nucleotide sequence encoding the same,
   wherein a complex of the CRISPR nuclease and the first RNA molecule targets the CRISPR nuclease to a SNP position of the mutant allele.

Embodiments of the present invention further comprise introduction of a donor DNA template for homology directed repair (HDR), alteration, or replacement of a target sequence of the RPS19 allele. In some embodiments, the donor DNA template for HDR (e.g., dsDNA or ssODN) is at least 10, 20, 30, 40, 50, 100, 200, 300, 400, 500, 600, 700, 800, 1,000, 1,250, 1,500, 2,000, 3,000, or 5,000 base pairs in length, at most 20, 30, 40, 50, 100, 200, 300, 400, 500, 600, 700, 800, 1,000, 1,250, 1,500, 2,000, 3,000, or 5,000 base pairs in length, or between 10 and 5000, 10 and 3000, 10 and 2000, 10 and 1000, 10 and 500, 10 and 400, 10 and 300, 10 and 200, 10 and 100, 10 and 60, 10 and 50, 20 and 5000, 20 and 3000, 20 and 2000, 20 and 1000, 20 and 500, 20 and 400, 20 and 300, 20 and 200, 20 and 100, 20 and 60, 20 and 50, 30 and 5000, 30 and 3000, 30 and 2000, 30 and 1000, 30 and 500, 30 and 400, 30 and 300, 30 and 200, 30 and 100, 30 and 60, or 30 and 50 base pairs in length. Each possibility represents a separate embodiment. In some embodiments, the donor DNA template for HDR overlaps in sequence complementarity with regions upstream and downstream double-strand break site induced by a nuclease programmed by any one of the guides described herein. In some embodiments, the donor DNA template for HDR comprises a sequence that overlaps in sequence complementarity with an entire exon or more.

According to some embodiments, the present disclosure provides an RNA sequence ('RNA molecule') which binds to/associates with and/or directs the RNA guided DNA nuclease e.g., CRISPR nuclease to a sequence comprising at least one nucleotide which differs between a mutant allele and a second allele (e.g., functional/wild type allele) of a gene of interest (i.e., a sequence of the mutant allele which is not present in the second allele).

In some embodiments, the method comprises the steps of: contacting a mutant allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutant allele of the gene of interest which differs by at least one nucleotide from a nucleotide sequence of a second allele of the gene of interest (i.e., a functional/wild type allele), thereby modifying the mutant allele.

Treatment of DBA

In embodiments of the present invention, the RNA molecules, compositions, methods, cells, kits, or medicaments are utilized for treating a subject having a disease phenotype resulting from the heterozygote RPS19 gene. In embodiments of the present invention, the disease is DBA. In such embodiments, the method results in improvement, amelioration or prevention of the disease phenotype. Any one of, or combination of, the above-mentioned strategies for bi-allelic cut and correction, or allele-specific targeting based on a heterozygous SNP or mutation sequence, may be used in the context of the invention.

In embodiments of the present invention, the RNA molecules, compositions, methods, cells, kits, or medicaments are utilized for treating a subject having a disease phenotype resulting from the RPS19 gene. In embodiments of the present invention, the disease is Diamond Blackan anemia (DBA). In such embodiments, the method results in improvement, amelioration or prevention of the disease phenotype.

In embodiments of the present invention, the RNA molecules, compositions, methods, cells, kits, or medicaments of the present invention are utilized in combination with a second therapy for DBA to treat the subject. In embodiments of the present invention, the RNA molecules, compositions, methods, kits, or medicaments of the present invention are administered prior to administration of the second therapy, during administration of the second therapy, and/or after administration of the second therapy.

In embodiments of the present invention, a cell with an RPS19 gene mutation associated with DBA may be from a subject with the RPS19 gene mutation and/or afflicted with DBA. Accordingly, selecting a cell with an RPS19 gene mutation may comprise selecting a subject with the RPS19 gene mutation. In further embodiments of the present invention, selecting a cell may comprise selecting a cell from a subject with the RPS19 gene mutation. In embodiments of the present invention, introducing the compositions of the subject invention to the cell may comprise introducing the compositions of the invention to the cell of a subject afflicted with the RPS19 gene mutation.

Accordingly, embodiments of the present invention encompass the screening of subjects or cells for the RPS19 gene. A person having ordinary skill in the art would readily understand methods of screening for mutations within the RPS19 gene in the art, by way of non-limiting examples, e.g., sequencing-by-synthesis, Sanger sequencing, karyotyping, Fluorescence In situ Hybridization, and/or microarray testing. In embodiments of the present invention, mutations within the RPS19 gene are screened by exon sequencing. In one embodiment of the invention, a subject is screened for heterozygous DBA mutation or SNPs prior to treatment with a composition that includes guide sequences of the present invention.

In embodiments of the present invention, a subject diagnosed with DBA is screened by Exon sequencing to identify an RPS19 pathogenic mutation in the RPS19 gene.

It is understood that the CRISPR/Cas9 gene editing system enables targeting the nuclease to a target site in a sequence specific manner to address disease-causing mutations. Hematopoietic stem and progenitor cells (HSPCs) have therapeutic potential because of their ability to both self-renew and differentiate (Yu, Natanson, and Dunbar 2016). Accordingly, embodiments of the present invention apply genome editing to HSPCs.

In embodiments of the present invention, an autologous therapy and utilizes autologous CD34+ hematopoietic stem cells from patients diagnosed with DBA which are edited with CRISPR/Cas9. In embodiments of the present invention, CD34+ cells are isolated from bone marrow or peripheral blood mononucleated cells (PBMCs) following patient apheresis.

In some embodiments, an allele-specific or bi-allelic targeting RNA molecule and a CRISPR nuclease are introduced to a cell encoding the gene of interest. In some embodiments, the cell encoding the gene of interest is in a mammalian subject. In some embodiments, the cell encoding the gene of interest is a eukaryotic cell. In some embodiments, the cell encoding the gene of interest is a mammalian cell.

In some embodiments, a nucleic acid template is further introduced to the cell encoding the gene of interest for homology-directed repair, alteration, or replacement of a target sequence of the gene of interest to correct/repair the gene of interest such as to express a functional protein.

In some embodiments, the mutant allele desired to be targeted for correction or modification is an allele of the RPS19 gene. In some embodiments, the RNA molecule targets a SNP which co-exists with or is genetically linked to the disease-causing mutation associated with DBA genetic disorder. In some embodiments, the RNA molecule targets a SNP which is highly prevalent in the population and exists in a mutant allele having the mutated sequence associated with DBA genetic disorder and not in a second allele (e.g., functional allele) of an individual subject to be treated. In some embodiments, a disease-causing mutation within a mutated RPS19 allele is targeted. In some embodiments, a non-discriminatory guide sequence targets a noncoding region common to both RPS19 alleles up to 250 base pairs from an exon bearing a pathogenic mutation of interest.

In some embodiments, the method is utilized for treating a subject having a disease phenotype resulting from a mutation in the RPS19 gene. In such embodiments, the method results in improvement, amelioration or prevention of the disease phenotype.

Embodiments referred to above refer to a CRISPR nuclease, RNA molecule(s), and optionally tracrRNA being effective in a subject or cells at the same time. The CRISPR, RNA molecule(s), and optionally tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

In one embodiment, the cell is a stem cell. In one embodiment, the cell is an embryonic stem cell. In some embodiment, the stem cell is a hematopoietic stem/progenitor cell (HSC). As used herein, the term HSC refers to both hematopoietic stem cells and hematopoietic stem progenitor cells. Non-limiting examples of stem cells include bone marrow cells, myeloid progenitor cells, a multipotent progenitor cells, a lineage restricted progenitor cells.

Dominant Genetic Disorders

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of a dominant genetic disorders such as Diamond-Blackfan anemia (DBA). In some embodiments, the genetic disorder is DBA. In some embodiments, the target gene is the RPS19 gene (Entrez Gene, gene ID No: 6223) which is located in chromosome 19 and encodes a ribosomal protein that is a component of the 40S subunit. The protein belongs to the S19E family of ribosomal proteins. Mutations in this gene may cause Diamond-Blackfan anemia (DBA), a constitutional erythroblastopenia characterized by absent or decreased erythroid precursors, in a subset of patients.

Table 1 hereinbelow discloses a non-limiting list of exemplary mutations in the RPS19 gene.

Any of the RPS19 mutations listed in Table 1 may be corrected or modified by one of the following strategies: (1) Utilizing a guide sequence targeting the pathogenic mutation itself to induce a DSB in proximity to the mutation in the mutant allele, and then using HDR for correction; (2) Utilizing a guide sequence targeting a SNP upstream or downstream of the pathogenic mutation listed in Table 1, or upstream or downstream of an exon bearing the pathogenic mutation, and then using HDR for correction; or (3) Utilizing a non-discriminatory guide sequence that targets a non-coding region common to both alleles of the gene and is up to 250 base pairs from an exon bearing a pathogenic mutation listed in Table 1 to induce a DSB in the non-coding region of both alleles, and then using HDR for correction of the mutation and/or correction or replacement of the exon bearing the pathogenic mutation.

Table 1: A non-limiting list of exemplary mutations in the RPS19 gene. The transcript for each of the mutations disclosed is the NM_001022.3 transcript. Mutations positions are indicated based on gnomAD v3 database and UCSC Genome Browser assembly ID: hg38, sequencing/assembly provider ID: Genome reference consortium Human GRCh38.p12 (GCA_00001405.27) Assembly date December 2013 initial release December 2017 patch release 12).

| Mutation position | Transcript Consequence (NM_001022) | NM_001022.4 (RPS19) |
|---|---|---|
| 19:41859951_T/C | c.-339T > C | Exon1 |
| 19:41860011_C/T | c.-279C > G | Exon1 |
| 19:41860139_G/T | c.-151G > T | Exon1 |
| 19:41860151_C/T | c.-139C > T | Exon1 |
| 19:41860216_C/T | c.-74C > T | Exon1 |
| 19:41860280_A/G | c.-10A > G | Exon1 |
| 19:41860303_C/T | c.-1 + 14C > T | Intron1 |
| 19:41860766_C/A | c.1-9C > A | Intron1 |
| 19:41860768_C/T | c.1-7C > T | Intron1 |
| 19:41860773_A/T | c.1-2A > T | Intron1 |
| 19:41860774_G/A | c.1-1G > A | Intron1 |
| 19:41860774_G/C | c.1-1G > C | Intron1 |
| 19:41860774_G/T | c.1-1G > T | Intron1 |
| 19:41860775_A/G | c.1A > G | Exon2 |
| 19:41860776_T/A | c.2T > A | Exon2 |
| 19:41860777_G/A | c.3G > A | Exon2 |
| 19:41860777_G/C | c.3G > C | Exon2 |
| 19:41860777_G/T | c.3G > T | Exon2 |
| 19:41860782_AGATT/A | c.10_13delGTTA | Exon2 |
| 19:41860786_T/TA | c.13_14insA | Exon2 |
| 19:41860787_AC/A | c.14delC | Exon2 |
| 19:41860792_AAAAGACGTGAACC/A | c.20_32del | Exon2 |
| 19:41860797_ACGTGAACCAGCAGGAGTT/A | c.25_42del | Exon2 |
| 19:41860802_T/TT | c.28_29insT | Exon2 |
| 19:41860804_CCAGCAGGAGTTCGT/C | c.34_47del | Exon2 |
| 19:41860805_C/T | c.31C > T | Exon2 |
| 19:41860808_C/T | c.34C > T | Exon2 |

| Mutation position | Transcript Consequence (NM_001022) | NM_001022.4 (RPS19) |
|---|---|---|
| 19:41860808_C/CAG | c.36_37insAG | Exon2 |
| 19:41860817_G/T | c.43G > T | Exon2 |
| 19:41860823_G/C | c.49G > C | Exon2 |
| 19:41860827_T/TAGA | c.53_54insAGA | Exon2 |
| 19:41860827_T/C | c.53T > C | Exon2 |
| 19:41860827_T/G | c.53T > G | Exon2 |
| 19:41860831_AG/A | c.58delG | Exon2 |
| 19:41860832_G/C | c.58G > C | Exon2 |
| 19:41860836_T/C | c.62T > C | Exon2 |
| 19:41860842_A/G | c.68A > G | Exon2 |
| 19:41860844_AAGTG/A | c.71 + 3_71 + 6delGAGT | Intron2 |
| 19:41860846_G/A | c.71 + 1G > A | Intron2 |
| 19:41860846_G/C | c.71 + 1G > C | Intron2 |
| 19:41860853_TG/T | c.71 + 12del | Intron2 |
| 19:41861110_A/C | c.72-2A > C | Intron2 |
| 19:41861111_G/A | c.72-1G > A | Intron2 |
| 19:41861123_T/G | c.83T > G | Exon3 |
| 19:41861127_AG/A | c.88delG | Exon3 |
| 19:41861129_TC/T | c.93delC | Exon3 |
| 19:41861138_G/A | c.98G > A | Exon3 |
| 19:41861141_T/TG | c.103dupG | Exon3 |
| 19:41861143_G/GA | c.104_105insA | Exon3 |
| 19:41861144_A/AT | c.105dup | Exon3 |
| 19:41861145_T/TA | c.106_107insA | Exon3 |
| 19:41861152_A/T | c.112A > T | Exon3 |
| 19:41861166_CAA/C | c.128_129del | Exon3 |
| 19:41861174_TT/AA | c.134_135delinsAA | Exon3 |
| 19:41861176_G/GCT | c.139_140insTC | Exon3 |
| 19:41861179_C/T | c.139C > T | Exon3 |
| 19:41861180_C/T | c.140C > T | Exon3 |
| 19:41861184_C/A | c.144C > A | Exon3 |
| 19:41861194_T/C | c.154T > C | Exon3 |
| 19:41861195_G/A | c.155G > A | Exon3 |
| 19:41861196_G/A | c.156G > A | Exon3 |
| 19:41861196_G/C | c.156G > C | Exon3 |
| 19:41861204_C/T | c.164C > T | Exon3 |
| 19:41861206_C/T | c.166C > T | Exon3 |
| 19:41861207_G/A | c.167G > A | Exon3 |

-continued

| Mutation position | Transcript Consequence (NM_001022) | NM_001022.4 (RPS19) |
|---|---|---|
| 19:41861209_G/C | c.169G > C | Exon3 |
| 19:41861212_G/C | c.172G > C | Exon3 |
| 19:41861213_G/C | c.172 + 1G > C | Intron3 |
| 19:41861213_G/T | c.172 + 1G > T | Intron3 |
| 19:41861217_G/C | c.172 + 5G > C | Intron3 |
| 19:41869023_ACCCCCAGCT/A | c.173-7_174del | Intron3 |
| 19:41869029_AG/A | c.173-1delG | Intron3 |
| 19:41869029_A/G | c.173-2A > G | Intron3 |
| 19:41869029_A/T | c.173-2A > T | Intron3 |
| 19:41869030_G/A | c.173-1G > A | Intron3 |
| 19:41869033_TC/CT | c.175_176delinsCT | Exon4 |
| 19:41869034_C/T | c.176C > T | Exon4 |
| 19:41869036_A/C | c.178A > C | Exon4 |
| 19:41869040_C/A | c.182C > A | Exon4 |
| 19:41869042_C/T | c.184C > T | Exon4 |
| 19:41869043_G/A | c.185G > A | Exon4 |
| 19:41869044_G/GCCA | c.187_188insCAC | Exon4 |
| 19:41869049_T/C | c.191T > C | Exon4 |
| 19:41869053_C/G | c.195C > G | Exon4 |
| 19:41869053_CCTCCGGGGTGG/C | c.197_207del | Exon4 |
| 19:41869058_C/CG | c.203_204insG | Exon4 |
| 19:41869066_G/A | c.208G > A | Exon4 |
| 19:41869070_G/A | c.212G > A | Exon4 |
| 19:41869078_TC/T | c.222delC | Exon4 |
| 19:41869084_A/C | c.226A > C | Exon4 |
| 19:41869087_AAGATCTATGGGGGACGTC/A | c.233_250del | Exon4 |
| 19:41869095_T/TG | c.242_243insG | Exon4 |
| 19:41869105_CAG/C | c.250_251delAG | Exon4 |
| 19:41869107_G/GA | c.250_251insA | Exon4 |
| 19:41869108_A/T | c.250A > T | Exon4 |
| 19:41869131_ACTTCAGCCGAGGCTCCAAGAGTGTGGCCCGC/A | c.274_304del | Exon4 |
| 19:41869138_C/T | c.280C > T | Exon4 |
| 19:41869139_G/T | c.281G > T | Exon4 |
| 19:41869140_A/AGG | c.283_284dupGG | Exon4 |
| 19:41869140_AG/A | c.284delG | Exon4 |
| 19:41869147_A/AAGGC | c.289_290insAGGC | Exon4 |
| 19:41869150_AGT/A | c.295_296delGT | Exon4 |
| 19:41869151_GTGTG/GTGTGTG | c.294_295TG[3] | Exon4 |

-continued

| Mutation position | Transcript Consequence (NM_001022) | NM_001022.4 (RPS19) |
|---|---|---|
| 19:41869152_T/TTG | c.294_295insTG | Exon4 |
| 19:41869159_C/T | c.301C > T | Exon4 |
| 19:41869160_G/A | c.302G > A | Exon4 |
| 19:41869162_CG/C | c.307delG | Exon4 |
| 19:41869163_G/C | c.305G > C | Exon4 |
| 19:41869166_T/A | c.308T > A | Exon4 |
| 19:41869178_T/C | c.320T > G | Exon4 |
| 19:41869185_GC/G | c.328delC | Exon4 |
| 19:41869192_A/ATGG | c.335_337TGG | Exon4 |
| 19:41869198_G/T | c.340G > T | Exon4 |
| 19:41869198_GA/G | c.341delA | Exon4 |
| 19:41869198_G/GAA | c.344_345insAA | Exon4 |
| 19:41869212_T/TG | c.356_356insG | Exon4 |
| 19:41869215_G/A | c.356 + 1G > A | Intron4 |
| 19:41869215_G/T | c.356 + 1G > T | Intron4 |
| 19:41869216_T/A | c.356 + 2T > A | Intron4 |
| 19:41869217_A/C | c.356 + 3A > C | Intron4 |
| 19:41869698_G/A | c.357-1G > A | Intron4 |
| 19:41869698_G/T | c.357-1G > T | Intron4 |
| 19:41869700_G/A | c.358G > A | Exon5 |
| 19:41869708_A/ACT | c.367_368dup | Exon5 |
| 19:41869713_C/CA | c.372_373insA | Exon5 |
| 19:41869718_C/T | c.376C > T | Exon5 |
| 19:41869718_C/CGGACAAAG | c.386_387insCGGACAAAG | Exon5 |
| 19:41869722_G/A | c.380G > A | Exon5 |
| 19:41869724_C/T | c.382C > T | Exon5 |
| 19:41869724_CAA/C | c.384_385delAA | Exon5 |
| 19:41869731_ATC/A | c.390_391delTC | Exon5 |
| 19:41869734_T/C | c.392T > C | Exon5 |
| 19:41869734_T/G | c.392T > G | Exon5 |
| 19:41869742_A/AT | c.401_402insT | Exon5 |
| 19:41869745_G/A | c.403G > A | Exon5 |
| 19:41869748_G/T | c.406G > T | Exon5 |
| 19:41869752_A/G | c.410A > G | Exon5 |
| 19:41869754_G/A | c.411 + 1G > A | Intron5 |
| 19:41869755_T/C | c.411 + 2T > C | Intron5 |
| 19:41871335_CCATCTTTTCCCACAGGTGG/C | c.412-13_417del | Exon6 |
| 19:41871349_AG/A | c.412delG | Exon6 |

-continued

| Mutation position | Transcript Consequence (NM_001022) | NM_001022.4 (RPS19) |
|---|---|---|
| 19:41871351_G/T | c.412G > T | Exon6 |
| 19:41871355_CA/A | c.417delA | Exon6 |
| 19:41871356_AG/A | c.418delG | Exon6 |

CRISPR Nucleases and PAM Recognition

In some embodiments, the sequence specific nuclease is an RNA guided DNA nuclease. In some embodiments, the RNA sequence which guides the RNA guided DNA nuclease binds to and directs the RNA guided DNA nuclease to (1) a sequence comprising at least one nucleotide which differs between a mutant allele and its counterpart functional allele (e.g., SNP or a pathogenic DBA mutation) or (2) to a non-coding region common to both alleles of a gene bearing the pathogenic mutation (i.e., both the functional allele and the allele bearing the pathogenic mutation). In additional embodiments, the RNA sequence which guides the RNA guided DNA nuclease binds to and directs the RNA guided DNA nuclease to a sequence at a distance of up to 1000 basepairs from an edge of an exon bearing a pathogenic mutation. In some embodiments, the CRISPR complex further comprises a tracrRNA. In some embodiments, the sequence specific nuclease is selected from CRISPR nucleases, or functional variants thereof. In a non-limiting example, in which the RNA guided DNA nuclease is a CRISPR protein, the at least one nucleotide which differs between a target allele (e.g., bearing a pathogenic mutation) and the other allele (e.g., bearing a different or the same pathogenic mutation) may be within the PAM site and/or proximal to the PAM site within the region that the RNA molecule is designed to hybridize to. In another non-limiting example, A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the proto-spacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for *Streptococcus pyogenes* Cas9 WT (Sp-CAS9); NNGRRT for *Staphylococcus aureus* (SaCas9); NNNVRYM for *Jejuni* Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

RNA molecules of the present invention are each designed to form complexes in conjunction with one or more different CRISPR nucleases and designed to target polynucleotide sequences of interest utilizing one or more different PAM sequences respective to the CRISPR nuclease utilized. Non-limiting examples of suitable PAM sequences include NGG, NGAN, NGNG, NGAG, NGCG, NNGRRT, NNNNGATT, TTTV, NNNVRYM, NRTAM, NAG, NNYAAT, NRTAM, NRRAR, NGGNR, NRTAH, NGGNG, and NRRWC.

In some embodiments, an RNA-guided DNA nuclease e.g., a CRISPR nuclease, may be used to induce a double-strand DNA break at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015-0211023, incorporated herein by reference.

CRISPR systems that may be used in the practice of the invention vary greatly. CRISPR systems can be a type I, a type II, type III or Type V system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Cas12a, Cas12b, Cas12c, Cas12d, Cas10d, CasF, CasG, CasH, Csy1, Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csz1, Csx15, Csf1, Csf2, Csf3, Csf4, and Cul966 (See Koonin 2017).

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas* sp., *Crocosphaera watsonii, Cyanothece* sp., *Microcystis aeruginosa, Synechococcus* sp., *Acetohalobium arabaticum, Ammonifex degensii, Caldicelulosiruptor becscii, Candidatus Desulforudis, Clostridium botulinum, Clostridium dificile, Finegoldia magna, Natranaerobius thermophilus, Pelotomaculum thermopropionicum, Acidithiobacillus caldus, Acidithiobacillus ferrooxidans, Allochromatium vinosum, Marinobacter* sp., *Nitrosococcus halophilus, Nitrosococcus watsoni, Pseudoalteromonas haloplanktis, Ktedonobacter racemifer, Methanohalobium evestigatum, Anabaena variabilis, Nodularia*

*spumigena, Nostoc* sp., *Arthrospira maxima, Arthrospira platensis, Arthrospira* sp., *Lyngbya* sp., *Microcoleus chthonoplastes, Oscillatoria* sp., *Petrotoga mobilis, Thermosipho africanus, Acaryochloris marina, Francisella* cf. *novicida* Fx1, *Alicyclobacillus acidoterrestris, Oleiphilus* sp., Bacterium CG09_39_24, Deltaproteobacteria bacterium, or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., spCas9 D1135E variant, spCas9 VQR variant, spCas9 EQR variant, or spCas9 VRER variant may also be used in the context of the invention.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from Acidaminococcus and Lachnospiraceae have been shown to carry out efficient genome-editing activity in human cells. (See Zetsche et al. (2015) Cell.).

In some embodiments, the CRISPR nuclease comprises one or more nuclear localization sequences (NLS), cell penetrating peptide sequences, and/or affinity tags. The NLS may be fused to the CRISPR nuclease or may be an in internal NLS. In an embodiment, the CRISPR nuclease comprises one or more nuclear localization sequences of sufficient strength to drive accumulation of a CRISPR complex comprising the CRISPR nuclease in a detectable amount in the nucleus of a eukaryotic cell.

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to one or more of: modified bases, modified sugar moieties, or modified inter-nucleoside linkages. Non-limiting examples of suitable chemical modifications include: 4-acetyleytidine, 5-(carboxyhydroxymethyl)uridine, 2'-O-methylcytidine, 5-carboxymethylaninomethyl-2-thiouridine, 5-carboxvmethylaminomethy luridine, dihydrouridine, 2'-O-nethylpseudouridine, "beta, D-galactosylqueuosine", 2'-O-methylguanosine, inosine, N6-isopentenyladenosine, 1-methyladenosine, 1-methylpseudouridine, 1-methylguanosine, 1-methylinosine, "2,2-dimethylguanosine", 2-methyladenosine, 2-methylguanosine, 3-methylcytidine, 5-methylcytidine, N6-methyladenosine, 7-methylguanosine, 5-methylaminomethyluridine, 5-methoxyaminomethyl-2-thiouridine, "beta, D-mannosylqueuosine", 5-methoxycarbonylmethyl-2-thiouridine, 5-methoxycarbonylmethyluridine, 5-methoxyuridine, 2-methylthio-N6-isopentenyladenosine, N-((9-beta-D-ribofuranosyl-2-methylthiopurine-6-yl)carbamoyl)threonine, N-((9-beta-D-ribofuranosylpurine-6-yl)N-methylcarbanoyl)threonine, uridine-5-oxyacetic acid-methylester, uridine-5-oxyacetic acid, wybutoxosine, queuosine, 2-thiocytidine, 5-methyl-2-thiouridine, 2-thiouridine, 4-thiouridine, 5-methyluridine, N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3) u", 2'-0-methyl (M), 3'-phosphorothioate (MS), 3'-thioPACE (MSP), pseudouridine, or 1-methyl pseudo-uridine. Each possibility represents a separate embodiment of the present invention.

Further non-limiting examples of suitable chemical modifications include: $m^1A$ (1-methyladenosine); $m^2A$ (2-methyladenosine); Am (2'-O-methyladenosine); $ms^2m^6A$ (2-methylthio-$N^6$-methyladenosine); $i^6A$ ($N^6$-isopentenyladenosine); $ms^2i6A$ (2-methylthio-$N^6$isopentenyladenosine); $io^6A$ ($N^6$-(cis-hydroxyisopentenyl)adenosine); $ms^2io^6A$ (2-methylthio-$N^6$-(cis-hydroxyisopentenyl) adenosine); $g^6A$ ($N^6$-glycinylcarbamoyladenosine); $t^6A$ ($N^6$-threonylcarbamoyladenosine); $ms^2t^6A$ (2-methylthio-$N^6$-threonyl carbamoyladenosine); $m^6t^6A$ ($N^6$-methyl-$N^6$-threonylcarbamoyladenosine); $hn^6A$($N^6$-hydroxynorvalylcarbamoyladenosine); $ms^2hn^6A$ (2-methylthio-$N^6$-hydroxynorvalyl carbamoyladenosine); Ar(p) (2'-O-ribosyladenosine (phosphate)); I (inosine); $m^1I$ (1-methylinosine); $m^1Im$ (1,2'-O-dimethylinosine); $m^3C$ (3-methylcytidine); Cm (2'-O-methylcytidine); $s^2C$ (2-thiocytidine); $ac^4C$ ($N^4$-acetylcytidine); $f^5C$ (5-formylcytidine); $m^5Cm$ (5,2'-O-dimethylcytidine); $ac^4Cm$ ($N^4$-acetyl-2'-O-methylcytidine); $k^2C$ (lysidine); miG (1-methylguanosine); $m^2G$ ($N^2$-methylguanosine); $m^7G$ (7-methylguanosine); Gm (2'-O-methylguanosine); $m^2$ 2G ($N^2,N^2$-dimethylguanosine); $m^2Gm$ ($N^2$'2'-O-dimethylguanosine); $m^2$ 2Gm ($N^2,N^2$, 2'-O-trimethylguanosine); Gr(p) (2'-O-ribosylguanosine (phosphate)); yW (wybutosine); $o_2yW$ (peroxywybutosine); OHyW (hydroxywybutosine); OHyW* (undermodified hydroxywybutosine); imG (wyosine); mimG (methylwyosine); Q (queuosine); oQ (epoxyqueuosine); galQ (galactosyl-queuosine); manQ (mannosyl-queuosine); $preQ_0$ (7-cyano-7-deazaguanosine); $preQ_1$ (7-aminomethyl-7-deazaguanosine); G (archaeosine); D (dihydrouridine); $m^5Um$ (5,2'-O-dimethyluridine); $s^4U$ (4-thiouridine); $m^5s^2U$ (5-methyl-2-thiouridine); $s^2Um$ (2-thio-2'-O-methyluridine); $acp^3U$ (3-(3-amino-3-carboxypropyl)uridine); $ho^5U$ (5-hydroxyuridine); $mo^5U$ (5-methoxyuridine); $cmo^5U$ (uridine 5-oxyacetic acid); $mcmo^5U$ (uridine 5-oxyacetic acid methyl ester); $chm^5U$ (5-(carboxyhydroxymethyl)uridine)); $mchm^5U$ (5-(carboxyhydroxymethyl)uridine methyl ester); $mcm^5U$ (5-methoxycarbonylmethyluridine); $mcm^5Um$ (5-methoxycarbonylmethyl-2'-O-methyluridine); $mcm^5s^2U$ (5-methoxycarbonylmethyl-2-thiouridine); $nm^5S^2U$ (5-aminomethyl-2-thiouridine); $mnm^5U$ (5-methylaminomethyluridine); $mnm^5s^2U$ (5-methylaminomethyl-2-thiouridine); $mnm^5se^2U$ (5-methylaminomethyl-2-selenouridine); $nCm^5U$ (5-carbamoylmethyluridine); $ncm^5Um$ (5-carbamoylmethyl-2'-O-methyluridine); $cmnm^5U$ (5-carboxymethylaminomethyluridine); $cmnm^5Um$ (5-carboxymethylaminomethyl-2'-O-methyluridine); $cmmm^5s^2U$ (5-carboxymethylaminomethyl-2-thiouridine); dimethyladenosine); Im (2'-O-methylinosine); $m^4C$ ($N^4$-methylcytidine); $m^4Cm$ ($N^4,2'$-O-dimethylcytidine); $hm^5C$ (5-hydroxymethylcytidine); $m^3U$ (3-methyluridine); $cm^5U$ (5-carboxymethyluridine); $m^6Am$ ($N^6,2'$-O-dimethyladenosine); $m^6 2Am$ ($N^6,N^6,$O-2'-trimethyladenosine); $m^{2'}7G$ ($N^2$,7-dimethylguanosine); m2,2,7G ($N^2,N^2$ 7-trimethylguanosine); $m^3Um$ (3,2'-O-dimethyluridine); $m^5D$ (5-methyldihydrouridine); $f^5Cm$ (5-formyl-2'-O-methylcytidine); $m^1 Gm$ (1,2'-O-dimethylguanosine); $m^1Am$ (1,2'-O-dimethyladenosine); $\tau m^5U$ (5-taurinomethyluridine); $\tau m^5s^2U$ (5-taurinomethyl-2-thiouridine)); imG-14 (4-demethylwyosine); imG2 (isowyosine); or $ac^6A$ ($N^6$-acetyladenosine). Each possibility represents a separate embodiment of the present invention. (See e.g. U.S. Pat. No. 9,750,824).

Delivery to Cells

It is understood that in the methods embodied, the RNA molecules and compositions described herein may be delivered to a target cell or subject by any suitable means. The following embodiments provide non-limiting examples of methods of delivery of the RNA molecules and composition of the present invention.

In some embodiments, RNA molecule compositions of the present invention may be targeted to any cell which contains and/or expresses a mutant allele or a dominant negative allele, including any mammalian or plant cell. For example, in one embodiment the RNA molecule specifically targets a mutated RPS19 allele and the target cell is an HSC. The delivery to the cell may be performed in-vitro, ex-vivo, or in-vivo. Further, the nucleic acid compositions described herein may be delivered as one or more of DNA molecules, RNA molecules, Ribonucleoproteins (RNP), nucleic acid vectors, or any combination thereof. In another example, the RNA molecule targets non-coding region common to both alleles of the RPS19 gene and up to 250 base pairs from an exon bearing a pathogenic mutation position of interest. In such a scenario, a double-strand break is induced in the non-coding region of both alleles, and the mutation of interest can be corrected by DNA repair pathway (e.g. HDR).

In some embodiments, the RNA molecule comprises a chemical modification. Non-limiting examples of suitable chemical modifications include 2'-0-methyl (M), 2'-0-methyl, 3'phosphorothioate (MS) or 2'-0-methyl, 3'thio-PACE (MSP), pseudouridine, and 1-methyl pseudo-uridine. Each possibility represents a separate embodiment of the present invention.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Felgner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., *Agrobacterium, Rhizobium* sp. NGR234, *Sinorhizoboium meliloti, Mesorhizobium loti*, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa® Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. Nos. 5,049,386, 4,946,787; and 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186, 183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al. (1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO-S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), perC6 cells, any plant cell (differentiated or undifferentiated), as well as insect cells such as *Spodoptera fugiperda* (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)).

Stem cells are isolated for transduction and differentiation using known methods. For example, stem cells are isolated from bone marrow cells by panning the bone marrow cells with antibodies which bind unwanted cells, such as CD4+ and CD8+(T cells), CD45+(panB cells), GR-1 (granulocytes), and lad (differentiated antigen presenting cells) (as a non-limiting example see Inaba et al. (1992) J. Exp. Med. 176:1693-1702). Stem cells that have been modified may also be used in some embodiments.

Typically, the cells are administered in a pharmaceutical composition comprising at least one pharmaceutically-acceptable carrier. The phrase "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. The phrase "pharmaceutically acceptable carrier" as used herein means a pharmaceutically-acceptable material, composition or vehicle, such as a liquid or solid filler, diluent, excipient, or solvent encapsulating material.

Any one of the RNA molecule compositions described herein is suitable for genome editing in either mitotic cells or post-mitotic cells or any cell which is not actively dividing, e.g., arrested cells. Examples of post-mitotic cells which may be edited using an RNA molecule composition of the present invention include, but are not limited to, a hepatocyte cell.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via IV injection.

Vectors suitable for introduction of transgenes into immune cells (e.g., T-cells) include non-integrating lentivirus vectors. See, e.g., U.S. Patent Publication No. 2009-0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to/associates with and/or directs the RNA guided DNA nuclease (E.G., CRISPR nuclease) to a sequence comprising at least one nucleotide which differs between a mutant allele and a functional allele (e.g., SNP, disease associated mutation) of a gene of interest (i.e., a sequence of the mutant allele which is not present in the functional allele, a sequence of one of the mutant alleles which is not present in the other mutant allele) or a sequence common to two mutant alleles of a gene of interest. The sequence may be within the disease associated mutation. The sequence may be upstream or downstream to the disease associated mutation. Any sequence difference between a mutant allele and the functional allele may be targeted by an RNA molecule of the present invention to inactivate the mutant allele, or otherwise disable its dominant disease-causing effects, while preserving the activity of the functional allele. In additional embodiments, there is provided an RNA molecule which binds to/associates with and/or directs the RNA guided DNA nuclease to a sequence in a non-coding region upstream or downstream to an exon baring a disease associated mutation.

The disclosed compositions and methods may also be used in the manufacture of a medicament for treating dominant genetic disorders in a patient.

Guide Sequences which Specifically Target a Mutant Allele

A given gene may contain thousands of SNPs. Utilizing a 24 base pair target window for targeting each SNP in a gene would require hundreds of thousands of guide sequences. Any given guide sequence when utilized to target a SNP may result in degradation of the guide sequence, limited activity, no activity, or off-target effects. Accordingly, suitable guide sequences are necessary for targeting a given gene. By on aspect of the present invention, a novel set of guide sequences have been identified for repairing/correcting/modifying a mutant allele of RPS19 gene to treat/ameliorate/prevent DBA.

One aspect of the present disclosure provides guide sequences capable of specifically targeting a mutant allele while leaving a second allele (e.g., functional allele) unmodified. The guide sequences of the present invention are designed to, and are most likely to, specifically differentiate between a mutant allele and a functional allele. Of all possible guide sequences which target a mutant allele desired to be edited/corrected/modified/repaired, the specific guide sequences disclosed herein are specifically effective to function with the disclosed embodiments.

The present disclosure also provides guide sequences capable of specifically targeting a mutant allele. Of all possible guide sequences which target the mutant allele desired to be edited/corrected/modified/repaired, the specific guide sequences disclosed herein are specifically effective to function with the disclosed embodiments.

Briefly, the guide sequences may have properties as follows: (1) targets a SNP/insertion/deletion/indel with a prevalence of heterozygosity in the general population, in a specific ethnic population, or in a patient population above 1% or 10%; (2) targets a location of a SNP/insertion/deletion/indel proximal to a portion of the gene e.g., within 250 base pairs of a mutation or exon of the gene; and (3) targets a mutant allele which by targeting a founder or common pathogenic mutation for the disease/gene. In some embodiments, the SNP/insertion/deletion/indel heterozygosity rate in a population of interest is above 1%, 2%, 3%, 4%, 5%, 6%, 7%, 8%, 9%, 10%, 11%, 12%, 13%, 14%, or 15%. Each possibility represents a separate embodiment and may be combined at will.

Guide sequences of the present invention may target a SNP position in a distance of less than 2000 nucleotides, 1000 nucleotides, 500 nucleotides, 400 nucleotides, 300 nucleotides, 250 nucleotides, 200 nucleotides, 100 nucleotides from the disease-associated mutation, or within the disease associated mutation. Each possibility represents a separate embodiment.

Guide sequences of the present invention also may: (1) target a heterozygous sequence in a SNP position for the targeted gene; (2) target a SNP position with a prevalence of the SNP/insertion/deletion/indel in the general population, in a specific ethnic population, or in a patient population above 1% or 10%; (3) have a guanine-cytosine content of greater than 30% and less than 85%; (4) have no repeats of seven or more thymine/uracil, guanine, cytosine, or adenine residues; (6) have no off-target of zero mismatches in the genome identified by off-target analysis.

The at least one nucleotide which differs between the mutant allele and the second allele (e.g., functional/wild type allele), may be upstream, downstream or within the sequence of the disease-causing mutation of the gene of interest. The at least one nucleotide which differs between the mutant allele and the second allele, may be within an exon or within an intron of the gene of interest.

In some embodiments, the at least one nucleotide is a single nucleotide polymorphism (SNP). In some embodiments, each of the nucleotide variants of the SNP may be expressed in the mutant allele (REF/SNP) and targeted by a guide sequence. In some embodiments, the SNP may be a founder or common pathogenic mutation.

In some embodiments, the at least one nucleotide which differs between the mutant allele and the functional allele is linked to/co-exists with the disease-causing mutation in high prevalence in a population. In such embodiments, "high prevalence" refers to at least 92%, 93%, 94%, 95%, 96%, 97%, 98%, 99%, or 100%. Each possibility represents a separate embodiment of the present invention. In one embodiment, the at least one nucleotide which differs between the mutant allele and the functional allele, is a disease-associated mutation.

Guide sequences of the present invention may satisfy any one of the above criteria and are most likely to differentiate between a mutant allele from its corresponding functional allele.

In some embodiments, the RNA molecule targets a SNP/REF sequence linked to a SNP position, such as in a non-limiting example: 19:41869228_A_G, 19:41869228_A_G, 19:41869823_T_C, rs1385169206, rs2075749, rs2075750, rs2075754. SNP ID NOs are based on NCBI's 2018 database of Single Nucleotide Polymorphisms (dbSNP). For variants with no available rs number, variant characteristics are indicated based on gnomAD v3 database and UCSC Genome Browser assembly ID: hg38, sequencing/assembly provider ID: Genome reference consortium Human GRCh38.p12 (GCA_00001405.27) Assembly date December 2013 initial release December 2017 patch release 12)).

Strategies for HDR repair of a pathogenic mutation associated with DBA may involve a guide sequence targeting the pathogenic mutation itself or alternatively a guide sequence targeting a SNP located upstream or downstream to the mutation to mediate a DSB in proximity to the mutation. The strategies may further include a sequence repair/correction step by utilizing a donor/template sequence that (e.g., a single-stranded donor oligonucleotides (ssODN), double-stranded Donor (PCR product), Minicircle or virus (rAAV or Lentivirus)). In some embodiments, a DSB is affected in a non-coding region of both alleles of a gene, and a donor template for HDR overlaps in sequence complementarity with an entire exon in which a pathogenic mutation is located.

In an exemplary strategy, a mutant allele bearing a disease associated mutation, such as rs104894711 (p.Arg62Trp c.184C>T) in exon 4 of chromosome 19, is targeted by guide sequences designed to target the disease-associated mutation itself. Non-limiting examples of such guide sequences are listed in Table 2.

In some embodiments, a mutant allele bearing a mutation is targeted by guide sequences designed to target SNP positions located up to 50, 100, 200, 500, 1000, 1500, 2000 bases from the pathogenic mutation. Each possibility represents a separate embodiment. Non-limiting examples of suitable guide sequences are indicated in Table 2.

In an exemplary strategy, a mutant allele bearing a mutation in exon 2 may be targeted by guide sequences designed to target a SNP position located in intron 2, such as rs1385169206 and rs2075749, or s SNP position located in intron 1, such as 19:41860325_C_T. Non-limiting examples of such guide sequences are indicated in Table 2. In another exemplary strategy, a mutant allele bearing a mutation in exon 3 may be targeted by guide sequences designed to target a SNP position located in intron 2, such as rs1385169206 and rs2075749, or a SNP position located in intron 3. Non-limiting examples of such guide sequences are indicated in Table 2. In another exemplary strategy, a mutant allele bearing a mutation in exon 4 or 5 may be targeted by guide sequences designed to target a SNP position located in intron 4, such as 19:41869228_A_G, and rs2075750. Non-limiting examples of such guide sequences are indicated in Table 2. In another exemplary strategy, a mutant allele bearing a mutation in exon 5 may be targeted by guide sequences designed to target a SNP position located in intron 5, such as rs2075754 and 19:41869823_T_C. Non-limiting examples of such guide sequences are indicated in Table 2.

Although a large number of guide sequences can be designed to target a mutant allele, a subset within the sequences identified by SEQ ID NOs: 1-20465 disclosed herein were specifically selected to effectively implement the methods set forth herein and to effectively discriminate between alleles.

A subset of guide sequences for use as described in the embodiments herein were designed to associate with different SNPs or mutations within a sequence of a mutated RPS19 allele. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1 (PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized.

Guide Sequences which Target a Sequence within a Non-Coding Region in a Proximity to an Exon Bearing a Pathogenic Mutation The present disclosure also provides guide sequences capable of specifically targeting a CRISPR nuclease to induce a DSB at a location that is 500, 250, or fewer nucleotides from the first or the last nucleotide of a coding region of the RPS19 gene containing the mutation associated with DBA desired to be edited/corrected/modified/repaired. The specific guide sequences disclosed herein are specifically effective to function with the disclosed embodiments.

Strategies for HDR repair of a pathogenic mutation associated with DBA may involve a guide sequence targeting a sequence within a non-coding region of the gene, in a distance of up to 1000, 500, 250, or fewer nucleotides from the first or the last nucleotide of a coding region of the RPS19 gene containing the mutation associated with DBA desired to be edited/corrected/modified/repaired. The strategies may further include a sequence repair/correction step by utilizing a donor/template sequence that (e.g., a single-stranded donor oligonucleotides (ssODN), double-stranded Donor (PCR product), Minicircle or virus (rAAV or Lentivirus)). In some embodiments, the donor/template sequence comprises a sequence complimentary to a region extending from the position of the DSB to a pathogenic mutation. In such embodiments, the donor/template sequence further comprises homology arms flanking the site of the DSB and the pathogenic mutation. In some embodiments, the donor/template sequence comprises a sequence complimentary to a region comprising an entire exon. In some embodiments, the exon containing the pathogenic mutation, or a portion thereof which contains the pathogenic mutation, is corrected or replaced to remove the pathogenic mutation.

In some embodiments, a mutant allele bearing a mutation and functional allele are targeted by guide sequences designed to target a sequences located in a non-coding region up to 50, 100, 200, 300, 400, 500, 600, 700, 800, 900, 1000, bases from an edge of a coding region bearing the pathogenic mutation. Each possibility represents a separate embodiment. Non-limiting examples of suitable guide sequences that associate with different sequences in a non-coding region of a RPS19 gene are indicated in Table 2.

In an exemplary strategy, a mutation in exon 1 may be targeted by guide sequences designed to target a sequence common to both alleles of a gene located up to 250 basepairs from exon 1 (Upstream_Exon_1) or located in intron 1 up to 250 basepairs from exon 1 (Downstream_Exon_1). In an exemplary strategy, a mutation in exon 2 may be targeted by guide sequences designed to target a sequence common to both alleles of a gene located in intron 1 up to 250 basepairs from exon 2 (Upstream_Exon_2) or intron 2 up to 250 basepairs from exon 2 (Downstream_Exon_2). In an exemplary strategy, a mutation in exon 3 may be targeted by guide sequences designed to target a sequence common to both alleles of a gene located in intron 2 up to 250 basepairs from the exon (Upstream_Exon_3) or in intron 3 up to 250 basepairs from the exon (Downstream_Exon_3). In an exemplary strategy, a mutation in exon 4 may be targeted by guide sequences designed to target a sequence common to both alleles of a gene located in intron 3 up to 250 basepairs from the exon (Upstream_Exon_4) or in intron 4 up to 250 basepairs from the exon (Downstream_Exon_4). In an exemplary strategy, a mutation in exon 5 may be targeted by guide sequences designed to target a sequence common to both alleles of a gene located in intron 4 up to 250 basepairs from the exon (Upstream_Exon_5) or in intron 5 up to 250 basepairs from the exon (Downstream_Exon_5). Non-limiting examples of suitable guide sequences for the exemplary strategies are indicated in Table 2.

In the present invention, a novel set of guide sequences have been identified for repairing/correcting/modifying a mutant allele of RPS19 gene to treat, ameliorate, or prevent DBA.

TABLE 2

Guide sequences designed for use as described in the embodiments herein. Each engineered guide molecule is further designed such as to associate with a target genomic DNA sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| 19:41859951_T_C | 1-46 | 47-94 | 95-144 |
| 19:41860011_C_T | 145-190 | 191-238 | 239-288 |
| 19:41860139_G_T | 289-334 | 335-382 | 383-432 |
| 19:41860151_C_T | 433-478 | 479-526 | 527-576 |
| 19:41860216_C_T | 577-622 | 623-670 | 671-720 |
| 19:41860280_A_G | 721-743 | 744-752 | 753-765 |
| 19:41860303_C_T | 766-810 | 811-853 | 854-899 |
| 19:41860766_C_A | 900-945 | 946-993 | 994-1043 |
| 19:41860768_C_T | 906, 929-930, 940, 1044-1085 | 952, 958, 965, 988, 1086-1129 | 995, 1007, 1011, 1014, 1130-1175 |
| 19:41860777_G_T | 1176-1221 | 1222-1269 | 1270-1319 |
| 19:41860817_G_T | 1320-1365 | 1366-1413 | 1414-1463 |
| 19:41860823_G_C | 1464-1509 | 1510-1557 | 1558-1607 |
| 19:41860842_A_G | 1608-1653 | 1654-1701 | 1702-1751 |
| 19:41860853_TG_T | 1752-1797 | 1798-1845 | 1846-1895 |
| 19:41861111_G_A | 1896-1941 | 1942-1989 | 1990-2039 |
| 19:41861138_G_A | 2040-2085 | 2086-2133 | 2134-2183 |
| 19:41861144_A_AT | 2184-2231 | 2232-2281 | 2282-2333 |
| 19:41861166_CAA_C | 2219, 2228, 2334-2377 | 2268, 2277, 2378-2423 | 2320, 2329, 2424-2471 |

TABLE 2-continued

Guide sequences designed for use as described in the embodiments herein. Each engineered
guide molecule is further designed such as to associate with a target genomic DNA
sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| 19:41861179_C_T | 2472-2517 | 2518-2565 | 2566-2615 |
| 19:41861204_C_T | 2616-2661 | 2662-2709 | 2710-2759 |
| 19:41861217_G_C | 2760-2805 | 2806-2853 | 2854-2903 |
| 19:41869029_A_G | 2904-2949 | 2950-2993 | 2994-3041 |
| 19:41869033_TC_CT | 3042-3087 | 3088-3135 | 3136-3185 |
| 19:41869036_A_C | 3065, 3069, 3186-3229 | 3106, 3121, 3230-3271 | 3152, 3157, 3272-3317 |
| 19:41869042_C_T | 3318-3363 | 3364-3411 | 3412-3461 |
| 19:41869043_G_A | 3322, 3328, 3335, 3346, 3349, 3360, 3462-3501 | 3369, 3377, 3382, 3391, 3394, 3397, 3502-3543 | 3412, 3417, 3426, 3440, 3446, 3448, 3544-3587 |
| 19:41869066_G_A | 3588-3633 | 3634-3681 | 3682-3731 |
| 19:41869108_A_T | 3732-3777 | 3778-3825 | 3826-3875 |
| 19:41869138_C_T | 3876-3921 | 3922-3969 | 3970-4019 |
| 19:41869140_A_AGG | 3895, 3907, 3911-3912, 4020-4065 | 3941, 3953, 3958, 3960, 4066-4113 | 3989, 3991, 4003, 4008, 4114-4163 |
| 19:41869151 GTGTG GTGTGTG | 4164-4213 | 4214-4264 | 4265-4318 |
| 19:41869152_T_TTG | 4172, 4181, 4191, 4208, 4213, 4319-4363 | 4220, 4232, 4242, 4258, 4263, 4364-4403 | 4271, 4282, 4294, 4312, 4317, 4404-4448 |
| 19:41869162_CG_C | 4040, 4043, 4050, 4056, 4059, 4449-4489 | 4087, 4090, 4097, 4103, 4106, 4490-4528 | 3989, 4135, 4145, 4151, 4154, 4529-4571 |
| 19:41869166_T_A | 4458, 4467, 4473, 4484, 4572-4613 | 4103, 4493, 4510, 4523, 4614-4649 | 4151, 4154, 4538, 4551, 4650-4691 |
| 19:41869192_A_ATGG | 4692-4743 | 4744-4797 | 4798-4853 |
| 19:41869217_A_C | 4727, 4729, 4854-4897 | 4781, 4783, 4792, 4898-4942 | 4837, 4839, 4848, 4943-4989 |
| 19:41869708_A_ACT | 4990-5039 | 5040-5091 | 5092-5145 |
| 19:41869722_G_A | 5146-5191 | 5192-5239 | 5240-5289 |
| 19:41869724_CAA_C | 5160, 5175, 5290-5333 | 5221, 5225, 5334-5379 | 5259, 5274, 5380-5427 |
| 19:41869724_C_T | 5160, 5162, 5173, 5175, 5308, 5319-5320, 5322, 5428-5465 | 5208, 5221-5222, 5225, 5349, 5353-5354, 5367, 5466-5505 | 5259, 5271, 5274-5275, 5395-5396, 5400, 5411, 5506-5547 |
| 19:41869748_G_T | 5548-5593 | 5594-5641 | 5642-5691 |
| 19:41869752_A_G | 5692-5737 | 5738-5785 | 5786-5835 |
| 19:41869755_T_C | 5710, 5735, 5836-5879 | 5750, 5758, 5880-5925 | 5809, 5824, 5926-5973 |
| 19:41860325_C_T | 5974-5977, 5977-5981, 5981-5983, 5983-5989, 5989-5991, 5991-5997, 5997-6000, 6000-6003, 6003-6009 | 6010-6011, 6011-6015, 6015-6017, 6017-6020 | 6021-6022, 6022-6027, 6027-6032, 6032-6036, 6036-6038, 6038-6041 |
| 19:41869228_A_G | 4858, 4864, 4882, 4894, 6042, 6042-6044, 6044-6045, 6045-6055, 6055-6060, 6060-6070, 6070-6079, 6079-6088, 6088-6093 | 4902, 4908, 4911, 4939, 6094-6097, 6097-6109, 6109-6113, 6113-6123, 6123-6126, 6126-6133, 6133-6134, 6134-6142, 6142-6147 | 4947, 4953, 4957, 4982, 6148-6151, 6151-6158, 6158-6168, 6168-6178, 6178-6181, 6181-6188, 6188-6189, 6189-6190, 6190-6203 |
| 19:41869823_T_C | 6204-6208, 6208-6211, 6211-6222, 6222-6223, 6223-6226, 6226-6240, 6240-6258, 6258-6261, 6261-6287 | 6288-6292, 6292-6295, 6295-6306, 6306-6307, 6307-6323, 6323-6345, 6345-6348, 6348-6349, 6349-6375 | 6376-6380, 6380-6395, 6395-6396, 6396-6397, 6397-6413, 6413-6420, 6420-6436, 6436-6439, 6439-6467 |
| rs1385169206 | 6468, 6468-6469, 6469-6474, 6474-6481, 6481-6482, 6482-6510, 6510-6513, 6513-6514, 6514-6517, 6517-6524, 6524-6536, 6536-6537, 6537-6547 | 6548, 6548-6555, 6555-6562, 6562-6563, 6563-6570, 6570-6571, 6571-6591, 6591-6594, 6594-6595, 6595-6602, 6602-6614, 6614-6615, 6615-6625 | 6626-6642, 6642-6643, 6643-6650, 6650-6651, 6651-6656, 6656-6657, 6657-6675, 6675-6678, 6678-6679, 6679-6688, 6688-6700, 6700-6701, 6701-6711 |
| rs2075749 | 6468-6469, 6471, 6473, 6476, 6479, 6479, 6482, 6484, 6489, 6498, 6501, | 6548, 6550, 6552, 6554, 6557, 6560, 6560, 6563, 6565, 6568, 6568, 6571, | 6627, 6629, 6631, 6633, 6637, 6640, 6640, 6643, 6645, 6648, 6648, 6651, |

TABLE 2-continued

Guide sequences designed for use as described in the embodiments herein. Each engineered
guide molecule is further designed such as to associate with a target genomic DNA
sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| | 6505-6506, 6509, 6518, 6521, 6526, 6528, 6530, 6530, 6532, 6532, 6535, 6540, 6542, 6542, 6544, 6546, 6712-6716, 6716-6724, 6724-6739, 6739-6753, 6753-6770 | 6576, 6586-6587, 6590, 6604, 6606, 6608, 6608, 6610, 6613, 6618, 6620, 6620, 6622, 6624, 6771-6775, 6775-6783, 6783-6787, 6787-6796, 6796-6827 | 6654, 6654, 6657, 6660, 6663, 6666, 6670-6671, 6674, 6690, 6692, 6694, 6694, 6696, 6699, 6704, 6706, 6708, 6710, 6828-6832, 6832-6840, 6840-6844, 6844-6864, 6864-6888 |
| rs2075750 | 6889-6892, 6892-6914, 6914-6918, 6918-6930, 6930-6941, 6941-6961, 6961-6962, 6962-6970, 6970-6972 | 6973-6976, 6976-6998, 6998-7004, 7004-7006, 7006-7017, 7017-7028, 7028-7050, 7050-7058, 7058-7060 | 7061-7064, 7064-7080, 7080-7087, 7087-7093, 7093-7095, 7095-7112, 7112-7119, 7119-7141, 7141-7152 |
| rs2075754 | 7153-7171, 7171-7178, 7178-7181, 7181-7185, 7185-7210, 7210-7216, 7216-7226, 7226-7236, 7236 | 7237-7255, 7255-7262, 7262-7265, 7265-7267, 7267-7296, 7296-7302, 7302-7312, 7312-7318, 7318-7324 | 7325-7351, 7351-7354, 7354-7356, 7356-7357, 7357-7373, 7373-7394, 7394-7404, 7404-7410, 7410-7416 |
| Downstream_Exon_1 | 777, 786, 792, 5977, 5989, 5997, 6000, 6009, 7417-7770 | 6011, 6015, 7771-8050 | 6022, 6032, 6038, 8051-8345 |
| Downstream_Exon_2 | 1757, 1765, 1770-1771, 6468-6469, 6471, 6473, 6476, 6478, 6482, 6484, 6486, 6489, 6491, 6501, 6503, 6505, 6509, 6512-6513, 6516, 6521, 6523- | 1803, 1811, 1815, 1817, 6548, 6550, 6552, 6554, 6557, 6559, 6563, 6565, 6567, 6571, 6573, 6576, 6584, 6586, 6590, 6593-6594, 6597, 6601-6603, | 1851, 1859, 1863, 1885, 6627, 6629, 6631, 6633, 6637, 6639, 6643, 6645, 6647, 6651, 6653, 6657, 6660, 6666, 6668, 6670, 6674, 6677-6678, 6681, |
| Downstream_Exon_2 | 6525, 6535, 6539, 6716, 6719, 6724, 6729, 6731, 6739, 6745, 6749, 6753, 6757, 8346-8757 | 6613, 6617, 6775, 6778, 6783, 6787, 6790, 6796, 6802, 6806, 6809, 6813, 8758-9163 | 6687-6689, 6699, 6703, 6832, 6835, 6840, 6844, 6855, 6861, 6864, 6866, 6869, 6873, 9164-9568 |
| Downstream_Exon_3 | 2775, 2782, 2797, 2800, 6468-6469, 6471, 6473, 6476, 6478, 6482, 6484, 6486, 6489, 6491, 6501, 6503, 6505, 6509, 6512-6513, 6516, 6521, 6523-6525, 6535, 6539, 6716, 6719, 6724, 6729, 6731, 6739, 6745, 6749, 6753, 6757, 8346-8347, 8349-8352, 8354-8356, 8358, 8360, 8363-8365, 8367, 8369-8370, 8372, 8375-8381, 8383, 8385, 8389, 8392-8393, 8396, 8399, 8404-8405, 8407, 8412, 8415-8418, 8421-8422, 8427, 8430-8431, 8433-8434, 8436, 8438-8440, 8444-8447, 8449-8454, 8456, 8459-8460, 8462-8464, 8468-8469, 8474, 8477-8478, 8481-8482, 8484-8485, 8487, 8489, 8491, 8493, 8496, | 2828-2829, 2845, 2848, 6548, 6550, 6552, 6554, 6557, 6559, 6563, 6565, 6567, 6571, 6573, 6576, 6584, 6586, 6590, 6593-6594, 6597, 6601-6603, 6613, 6617, 6775, 6778, 6783, 6787, 6790, 6796, 6802, 6806, 6809, 6813, 8758-8759, 8761-8764, 8766-8768, 8770, 8772, 8775-8777, 8779, 8781-8782, 8784, 8787-8793, 8795, 8801, 8804-8805, 8808, 8810, 8815-8816, 8818, 8823, 8826-8829, 8832-8833, 8838, 8840-8841, 8843-8844, 8846, 8848-8850, 8854-8857, 8859-8864, 8866, 8869-8870, 8872-8874, 8878-8879, 8884, 8887-8888, 8891-8892, 8894-8895, 8897, 8899, 8901, 8903, 8907, 8909-8911, | 2861, 2878-2879, 2898, 6627, 6629, 6631, 6633, 6637, 6639, 6643, 6645, 6647, 6651, 6653, 6657, 6660, 6666, 6668, 6670, 6674, 6677-6678, 6681, 6687-6689, 6699, 6703, 6832, 6835, 6840, 6844, 6855, 6861, 6864, 6866, 6869, 6873, 9164-9165, 9167-9170, 9172-9174, 9176, 9178, 9181-9183, 9185, 9187-9188, 9190, 9193-9199, 9201, 9207, 9210-9211, 9214, 9216, 9221-9222, 9224, 9229, 9232-9235, 9238-9239, 9244, 9246-9247, 9249-9250, 9252, 9254-9256, 9260-9263, 9265-9270, 9272, 9275-9276, 9278-9280, 9284-9285, 9290, 9293-9294, 9297-9298, 9300-9301, 9303, 9305, 9307, 9309, 9313, |

TABLE 2-continued

Guide sequences designed for use as described in the embodiments herein. Each engineered
guide molecule is further designed such as to associate with a target genomic DNA
sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| | 8499, 8501-8503, | 8916-8917, 8920, | 9315-9317, 9322- |
| | 8508-8509, 8512, | 8924, 8929-8930, | 9323, 9326, 9330, |
| | 8516, 8521-8522, | 8934-8935, 8942- | 9336-9337, 9341- |
| | 8526-8527, 8533- | 8943, 8945, 8952, | 9342, 9349-9350, |
| | 8534, 8536, 8543, | 8955, 8960-8961, | 9352, 9359, 9362, |
| | 8546, 8551-8552, | 8963, 8975-8977, | 9367-9368, 9370, |
| | 8554, 8566-8568, | 8979-8981, 8984, | 9382-9384, 9386- |
| | 8570-8572, 8575, | 8989, 8995, 8998- | 9388, 9391, 9396, |
| Downstream_Exon_3 | 8580, 8586, 8589- | 8999, 9003-9004, | 9402, 9405-9406, |
| | 8590, 8594-8595, | 9006, 9008, 9010, | 9410-9411, 9413, |
| | 8597, 8599, 8601, | 9017, 9019, 9023, | 9415, 9424, 9426, |
| | 8608, 8610, 8614, | 9025, 9027-9030, | 9429, 9431, 9433- |
| | 8616, 8618-8621, | 9034, 9038-9040, | 9436, 9440, 9444- |
| | 8625, 8629-8631, | 9042, 9045-9046, | 9445, 9447, 9451, |
| | 8633, 8637-8638, | 9050, 9055, 9059- | 9452, 9456, 9461, |
| | 8642, 8647, 8651- | 9064, 9067, 9070, | 9465-9470, 9473, |
| | 8656, 8659, 8662, | 9072-9073, 9076, | 9476, 9478-9479, |
| | 8664-8665, 8668, | 9079-9080, 9083- | 9482, 9485-9486, |
| | 8671-8672, 8675- | 9084, 9086-9088, | 9489-9490, 9492- |
| | 8676, 8678-8679, | 9092, 9095, 9099, | 9493, 9495, 9499, |
| | 8681, 8685, 8688, | 9106-9107, 9110- | 9502, 9506, 9513- |
| | 8692, 8699-8700, | 9112, 9116-9120, | 9514, 9517-9519, |
| | 8703-8705, 8709- | 9123, 9125, 9132, | 9523-9527, 9529, |
| | 8713, 8716, 8718, | 9136, 9142-9143, | 9531, 9538, 9542, |
| | 8725, 8729, 8735- | 9146-9147, 9150- | 9548-9549, 9552- |
| | 8736, 8739-8740, | 9151, 9155, 9158, | 9553, 9556-9557, |
| | 8743-8744, 8748, | 9803-10028 | 9561, 9564, |
| | 8751, 9569-9802 | | 10029-10256 |
| Downstream_Exon_4 | 4858, 4864, 4894, | 4902, 4908, 4911, | 4947, 4957, 4982, |
| | 6045, 6052, 6056, | 6099, 6106, 6112, | 6152, 6158, 6160, |
| | 6059, 6061, 6070, | 6114, 6123-6124, | 6167, 6169, 6178- |
| | 6072, 6079, 6088, | 6133-6134, 6142, | 6179, 6188, 6190, |
| | 6090-6091, | 6144-6145, 10678- | 6199, 6201, |
| | 10257-10677 | 11081 | 11082-11490 |
| Downstream_Exon_5 | 5856, 5869, 6206, | 5888, 5914, 6290, | 5934, 5942, 6378, |
| | 6211-6212, 6214, | 6295-6296, 6298, | 6383, 6385, 6387, |
| | 6216-6217, 6222, | 6300-6301, 6306, | 6389-6390, 6395- |
| | 6226-6227, 6229, | 6310, 6312, 6314, | 6396, 6400, 6402, |
| | 6237, 6247, 6250, | 6322, 6334, 6337, | 6404, 6412, 6425, |
| | 6252, 6256, 6258- | 6339, 6343, 6345- | 6428, 6430, 6434, |
| | 6259, 6264, 6266, | 6346, 6348, 6352, | 6436-6437, 6439, |
| | 6268, 6270, 6277, | 6354, 6356, 6358, | 6444, 6446, 6448, |
| | 6279, 6889-6890, | 6365, 6367, 6973- | 6450, 6457, 6459, |
| | 6894, 6896, 6900, | 6974, 6978, 6980, | 7061-7062, 7066, |
| | 6902, 6906, 6910, | 6984, 6986, 6990, | 7068, 7072, 7074, |
| | 6914-6915, 6920, | 6994, 6998-6999, | 7078, 7080, 7083, |
| | 6924, 6930-6931, | 7001, 7007, 7011, | 7087-7088, 7090, |
| | 6941-6942, 6948, | 7017-7018, 7028- | 7096, 7100, 7106, |
| | 6952, 6954, 6957, | 7029, 7035, 7039, | 7108, 7119-7120, |
| | 6962, 6965, 6967, | 7041, 7044, 7050, | 7126, 7130, 7132, |
| | 11491-11893 | 7053, 7055, | 7135, 7141, 7144, |
| | | 11894-12290 | 7146, 12291- |
| | | | 12685 |
| Downstream_Exon_6 | 7153, 7155, 7157, | 7237, 7239, 7241, | 7325, 7327, 7329, |
| | 7160, 7165, 7168, | 7244, 7249, 7252, | 7332, 7337, 7340, |
| Downstream_Exon_6 | 7171-7172, 7176, | 7255-7256, 7260, | 7343, 7345, 7349, |
| | 7178, 7181, 7188, | 7262, 7265, 7267, | 7351, 7354, 7356- |
| | 7193, 7199, 7202, | 7274, 7279, 7285, | 7357, 7364, 7369, |
| | 7207, 7211, 7217, | 7288, 7293, 7297, | 7376, 7379, 7384, |
| | 7219, 7225, 7227, | 7303, 7305, 7311, | 7389, 7395, 7397, |
| | 7232, 7236, | 7313, 7319, 7323, | 7403, 7405, 7411, |
| | 12686-12849, | 13108-13518 | 7415, 13519- |
| | 12849-13107 | | 13934 |
| Upstream_Exon_1 | 5975, 5981, 5983, | 6017, 14291- | 6027, 6036, |
| | 5991, 6003, | 14574 | 14575-14874 |
| | 13935-14290 | | |
| Upstream_Exon_2 | 915, 918, 930, | 962, 965, 972, 988, | 1011, 1014, 1021, |
| | 940, 1071, 1080, | 1113, 1124, 6555, | 1025, 1157, 1168, |
| | 6474, 6479, 6481, | 6560, 6562, 6568, | 6634, 6640, 6642, |
| | 6487, 6492, 6494, | 6570, 6574, 6577, | 6648, 6650, 6654, |
| | 6496, 6498, 6506, | 6579, 6587, 6591, | 6656, 6658, 6661, |
| | 6510, 6514, 6517- | 6595, 6598, 6604, | 6663, 6671, 6675, |
| | 6518, 6526, 6528, | 6606, 6608, 6610, | 6679, 6682, 6690, |

TABLE 2-continued

Guide sequences designed for use as described in the embodiments herein. Each engineered
guide molecule is further designed such as to associate with a target genomic DNA
sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| | 6530, 6532, 6536-6537, 6540, 6542, 6544, 6546, 6720, 6725, 6733, 6737, 6742, 6746, 6752, 6754, 6758, 6764, 6767, 14875-15284 | 6614-6615, 6618, 6620, 6622, 6624, 6779, 6784, 6792, 6794, 6799, 6803, 6807, 6810, 6814, 6821, 6824, 15285-15688 | 6692, 6694, 6696, 6700-6701, 6704, 6706, 6708, 6710, 6836, 6841, 6848, 6852, 6858, 6862, 6867, 6870, 6874, 6881, 6884, 15689-16091 |
| Upstream_Exon_3 | 6474, 6479, 6481, 6487, 6492, 6494, 6496, 6498, 6506, 6510, 6514, 6517-6518, 6526, 6528, 6530, 6532, 6536-6537, 6540, 6542, 6544, 6546, 6720, 6725, 6733, 6737, 6742, 6746, 6752, 6754, 6758, 6764, 6767, 14875-14876, 14879, 14884, 14889, 14891, 14896, 14899, 14901, 14908, 14910-14913, 14916, 14922, 14924-14926, 14930, 14932-14933, | 6555, 6560, 6562, 6568, 6570, 6574, 6577, 6579, 6587, 6591, 6595, 6598, 6604, 6606, 6608, 6610, 6614-6615, 6618, 6620, 6622, 6624, 6779, 6784, 6792, 6794, 6799, 6803, 6807, 6810, 6814, 6821, 6824, 15285-15286, 15289, 15294, 15298, 15300, 15305, 15308, 15310, 15317, 15319-15322, 15325, 15331, 15333-15335, 15339, 15341-15342, 15344, | 6634, 6640, 6642, 6648, 6650, 6654, 6656, 6658, 6661, 6663, 6671, 6675, 6679, 6682, 6690, 6692, 6694, 6696, 6700-6701, 6704, 6706, 6708, 6710, 6836, 6841, 6848, 6852, 6858, 6862, 6867, 6870, 6874, 6881, 6884, 15689-15690, 15693, 15698, 15702, 15704, 15709, 15712, 15714, 15721, 15723-15726, 15729, 15735, 15737-15739, 15743, 15745- |
| Upstream_Exon_3 | 14935, 14940-14942, 14948-14950, 14953, 14955-14956, 14961, 14963, 14967-14970, 14972-14973, 14975, 14979, 14986, 14988, 14992, 14994, 14999, 15001-15002, 15004, 15007, 15010, 15012-15014, 15018-15022, 15029, 15035-15040, 15043, 15048, 15052-15053, 15055, 15061-15064, 15066, 15072, 15075, 15079-15081, 15084, 15088-15089, 15091, 15095, 15097, 15101-15103, 15107, 15109-15111, 15114, 15116-15118, 15121, 15125, 15129, 15133, 15138, 15141, 15144, 15148, 15150-15151, 15155-15156, 15158, 15164, 15168-15170, 15175-15176, 15178-15180, 15182-15183, 15186-15187, 15190, 15193-15196, 15200, 15202- | 15349-15351, 15357-15358, 15361, 15363-15364, 15369, 15371, 15374-15377, 15379-15380, 15382, 15386, 15393, 15395, 15399, 15401, 15406, 15408-15409, 15411, 15414, 15417, 15419-15421, 15425-15429, 15440-15445, 15448, 15453, 15457-15458, 15460, 15466-15470, 15476, 15479, 15483-15485, 15488, 15492-15493, 15495, 15499, 15501, 15505-15507, 15511, 15513-15515, 15518, 15520-15522, 15525, 15529, 15533, 15537, 15542, 15545, 15548, 15552, 15554-15555, 15559-15560, 15562, 15568, 15572-15574, 15579-15580, 15582, 15584-15585, 15587-15588, 15591-15592, 15595, 15598-15601, 15604, 15606-15607, 15609, | 15746, 15748, 15753-15755, 15761-15762, 15765, 15767, 15772, 15774, 15778-15781, 15783-15784, 15786, 15790, 15797, 15799, 15803, 15805, 15810, 15812-15813, 15815, 15818, 15821, 15823-15825, 15829-15833, 15844-15849, 15852, 15857, 15862-15863, 15865, 15871-15875, 15881, 15884, 15888-15890, 15896-15897, 15899, 15903, 15905, 15909-15911, 15914, 15916-15918, 15921, 15923-15925, 15928, 15932, 15936, 15940, 15945, 15948, 15951, 15955, 15957-15958, 15962-15963, 15965, 15971, 15975-15977, 15982-15983, 15985, 15987-15988, 15990-15991, 15994-15995, 15998, 16001-16004, 16007, 16009-16010, 16012, |

TABLE 2-continued

Guide sequences designed for use as described in the embodiments herein. Each engineered
guide molecule is further designed such as to associate with a target genomic DNA
sequence of interest that lies next to a protospacer adjacent motif (PAM).

| Target | SEQ ID NOs of 20 base guides | SEQ ID NOs of 21 base guides | SEQ ID NOs of 22 base guides |
|---|---|---|---|
| Upstream_Exon_3 | 15203, 15205, 15208-15209, 15214, 15216, 15219, 15222-15223, 15227, 15231, 15233, 15235-15237, 15239-15240, 15243-15244, 15248-15252, 15254-15256, 15259, 15262-15264, 15266, 15268-15269, 15271, 15273-15277, 15279-15280, 15282-15284, 16092-16329 | 15612-15613, 15618, 15620, 15623, 15626-15627, 15631, 15635, 15637, 15639-15641, 15643-15644, 15647-15648, 15652-15656, 15658-15660, 15663, 15666-15668, 15670, 15672-15673, 15675, 15677-15681, 15683-15684, 15686-15688, 16330-16559 | 16015-16016, 16021, 16023, 16026, 16029-16030, 16034, 16038, 16040, 16042-16044, 16046-16047, 16050-16051, 16055-16059, 16062-16064, 16067, 16069-16071, 16073, 16075-16076, 16078, 16080-16084, 16086-16087, 16089-16091, 16560-16791 |
| Upstream_Exon_4 | 2905, 6043, 6046, 6049, 6051, 6058, 6074, 6077, 6082-6087, 6089, 16792-17211 | 2950, 6096, 6100, 6103, 6105, 6111, 6127, 6131, 6136-6141, 6143, 17212-17613 | 3032, 6150, 6153, 6156, 6159, 6166, 6182, 6186, 6192-6197, 6200, 17614-18021 |
| Upstream_Exon_5 | 6205, 6208, 6210, 6221, 6223, 6225, 6232, 6234, 6236, 6239-6240, 6242, 6244, 6246, 6255, 6261, 6263, 6273, 6275, 6282, 6284, 6286-6287, 6892, 6899, 6905, 6909, 6913, 6918-6919, 6923, 6927, 6929, 6934, 6936, 6938, 6940, 6945, 6947, 6951, 6960-6961, 6964, 6970-6972, 18022-18425 | 6289, 6292, 6294, 6305, 6307, 6309, 6317, 6319, 6321, 6323, 6325, 6327, 6329, 6331, 6333, 6342, 6349, 6351, 6361, 6363, 6370, 6372, 6374-6375, 6976, 6983, 6989, 6993, 6997, 7004-7006, 7010, 7014, 7016, 7021, 7023, 7025, 7027, 7032, 7034, 7038, 7047, 7049, 7052, 7058-7060, 18426-18822 | 6377, 6380, 6382, 6394, 6397, 6399, 6407, 6409, 6411, 6413, 6415, 6417, 6419-6420, 6422, 6424, 6433, 6441, 6443, 6453, 6455, 6462, 6464, 6466-6467, 7064, 7071, 7077, 7082, 7086, 7093-7095, 7099, 7103, 7105, 7111-7112, 7114, 7116, 7118, 7123, 7125, 7129, 7138, 7140, 7143, 7150-7152, 18823-19217 |
| Upstream_Exon_6 | 7162, 7164, 7170, 7175, 7180, 7184-7185, 7187, 7190, 7192, 7195, 7198, 7204, 7206, 7209-7210, 7214, 7216, 7222, 7224, 7226, 7230, 7235, 11629, 19218-19515, 19515-19638 | 7246, 7248, 7254, 7259, 7264, 7269, 7271, 7273, 7276, 7278, 7281, 7284, 7290, 7292, 7295-7296, 7300, 7302, 7308, 7310, 7312, 7316, 7318, 7322, 19639-20049 | 7334, 7336, 7342, 7348, 7353, 7359, 7361, 7363, 7366, 7368, 7371, 7373, 7375, 7381, 7383, 7386, 7388, 7392, 7394, 7400, 7402, 7404, 7408, 7410, |
| Upstream_Exon_6 | | | 7414, 20050-20465 |

The SNP ID NOs indicated in Table 2 are based on NCBI's 2018 database of Single Nucleotide Polymorphisms (dbSNP). For variants/mutations with no available rs number, variant/mutation characteristics are indicated based on gnomAD v3 database and UCSC Genome Browser assembly ID: hg38, sequencing/assembly provider ID: Genome reference consortium Human GRCh38.p12 (GCA_00001405.27) Assembly date December 2013 initial release December 2017 patch release 12).

For the foregoing embodiments, each embodiment disclosed herein is contemplated as being applicable to each of the other disclosed embodiments. For example, it is understood that any of the RNA molecules or compositions of the present invention may be utilized in any of the methods of the present invention.

EXPERIMENTAL DETAILS

Example 1: RPS19 Correction Analysis

Guide sequences comprising 17-22 contiguous nucleotides containing nucleotides in the sequence set forth in any one of SEQ ID NOs 1-20465 are screened for high on target activity. On target activity is determined by DNA capillary electrophoresis analysis.

According to DNA capillary electrophoresis analysis, guide sequences comprising 17-22 contiguous nucleotides containing nucleotides in the sequence set forth in any one of SEQ ID NOs 1-20465 are found to be suitable for correction of the RPS19 gene. In some embodiments, the guide sequences are suitable for specific, on target activity against only a RPS19 mutant allele. In additional embodiments, the guide sequences are suitable for non-discriminatory targeting to any RPS19 allele.

Example 2: RPS19 Guide Activity Test

Figure 2:
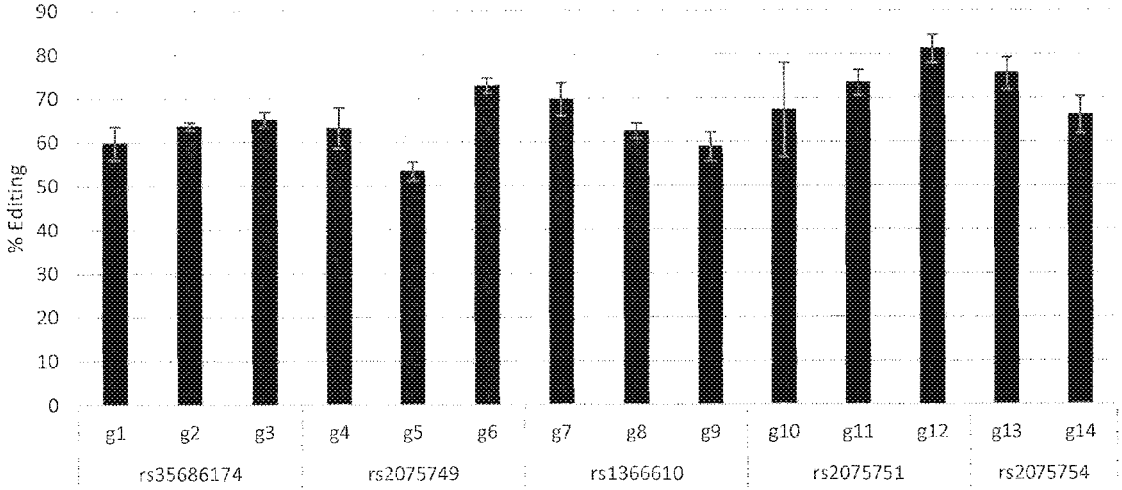
FIG. 2: Screen for activity of guides targeting RPS19 in Hela cells. A spCas9 coding plasmid was co-transfected with each of the guide DNA plasmids. Cells were harvested 72 h post DNA transfection. Genomic DNA was extracted and used for IDAA using on-target primers which amplify the endogenous genomic regions. The graph represents the average % editing (±standard deviation) of three independent experiments. The guides shown in FIG. 2 correspond to the sequence listing as follows: g1 (SEQ ID NO: 6496), g2 (SEQ ID NO: 6479), g3 (SEQ ID NO: 6539), g4 (SEQ ID NO: 6544), g5 (SEQ ID NO: 6471), g6 (SEQ ID NO: 6482), g7 (SEQ ID NO: 6053), g8 (SEQ ID NO: 6075), g9 (SEQ ID NO: 6047), g10 (SEQ ID NO: 6212), g11 (SEQ ID NO: 6275), g12 (SEQ ID NO: 6268), g13 (SEQ ID NO: 7199), and g14 (SEQ ID NO: 7160).

To choose the optimal guides for editing strategies in RPS19-mediated DBA indication, 14 different DNA guides, which are targeting SNPs in different areas of RPS19 relevant to the therapeutic editing strategies, were screened for high on target activity in HeLa cells, which are homozygous to the reference allele. Briefly, spCas9 coding plasmid (64 ng) was co-transfected with each of the guide DNA plasmids (20 ng) in 96 well plate format using jetOPTIMUS reagent (Polyplus). Cells were harvested 72 h post DNA transfection. Genomic DNA was extracted and used for Indel Detection by Amplicon Analysis (IDAA) using on-target primers which amplify the endogenous genomic regions. The graph in FIG. 2 represents the average % editing (±standard deviation) of three independent experiments. According to capillary electrophoreses analysis, all guides show activity ranging between 50%-80%.

---

SEQUENCE LISTING (20470 sequences)

SEQ ID NO: 1 - RNA, 20 nt, Artificial Sequence
  Guide Sequence
aaggagcagugguggagaau

SEQ ID NO: 2 - RNA, 20 nt, Artificial Sequence
  Guide Sequence
accacugcuccuuccagcca

SEQ ID NO: 3 - RNA, 20 nt, Artificial Sequence
  Guide Sequence
acugcuccuuccagccacga

SEQ ID NO: 4 - RNA, 20 nt, Artificial Sequence
  Guide Sequence
agcagugguggagaauacua

SEQ ID NO: 5 - RNA, 20 nt, Artificial Sequence
  Guide Sequence
aggagcagugguggagaaua

SEQ ID NO: 6 - RNA, 20 nt, Artificial Sequence
  Guide Sequence
aguauucuccaccacugcuc

SEQ ID NO: 7 - RNA, 20 nt, Artificial Sequence
  Guide Sequence
auaguauucuccaccacugc

SEQ ID NO: 8 - RNA, 20 nt, Artificial Sequence
  Guide Sequence
aucauaguauucuccaccac

SEQ ID NO: 9 - RNA, 20 nt, Artificial Sequence
  Guide Sequence
auucuccaccacugcuccuu

SEQ ID NO: 10 - RNA, 20 nt, Artificial Sequence
  Guide Sequence
caccacugcuccuuccagcc

SEQ ID NO: 11 - RNA, 20 nt, Artificial Sequence
  Guide Sequence
cacugcuccuuccagccacg

SEQ ID NO: 12 - RNA, 20 nt, Artificial Sequence
  Guide Sequence
cauaguauucuccaccacug

SEQ ID NO: 13 - RNA, 20 nt, Artificial Sequence
  Guide Sequence
caucauaguauucuccacca

SEQ ID NO: 14 - RNA, 20 nt, Artificial Sequence
  Guide Sequence
ccaccacugcuccuuccagc

SEQ ID NO: 15 - RNA, 20 nt, Artificial Sequence
  Guide Sequence
ccacugcuccuuccagccac

SEQ ID NO: 16 - RNA, 20 nt, Artificial Sequence
  Guide Sequence
cgucguucguggcuggaagg

SEQ ID NO: 17 - RNA, 20 nt, Artificial Sequence
  Guide Sequence
cguggcuggaaggagcagug

SEQ ID NO: 18 - RNA, 20 nt, Artificial Sequence
  Guide Sequence
cguucguggcuggaaggagc

SEQ ID NO: 19 - RNA, 20 nt, Artificial Sequence
  Guide Sequence
cuccaccacugcuccuucca

SEQ ID NO: 20 - RNA, 20 nt, Artificial Sequence
  Guide Sequence
cugcuccuuccagccacgaa

SEQ ID NO: 21 - RNA, 20 nt, Artificial Sequence
  Guide Sequence
cuggaaggagcaguggugga

SEQ ID NO: 22 - RNA, 20 nt, Artificial Sequence
  Guide Sequence
gaaggagcagugguggagaa

SEQ ID NO: 23 - RNA, 20 nt, Artificial Sequence
  Guide Sequence
gagcagugguggagaauacu

SEQ ID NO: 24 - RNA, 20 nt, Artificial Sequence
  Guide Sequence
gcgucguucguggcuggaag

SEQ ID NO: 25 - RNA, 20 nt, Artificial Sequence
  Guide Sequence
gcuccuuccagccacgaacg

SEQ ID NO: 26 - RNA, 20 nt, Artificial Sequence
  Guide Sequence
gcuggaaggagcaguggugg

SEQ ID NO: 27 - RNA, 20 nt, Artificial Sequence
  Guide Sequence
ggaaggagcagugguggaga

SEQ ID NO: 28 - RNA, 20 nt, Artificial Sequence
  Guide Sequence
ggagcagugguggagaauac

SEQ ID NO: 29 - RNA, 20 nt, Artificial Sequence
  Guide Sequence
ggcuggaaggagcaguggug

SEQ ID NO: 30 - RNA, 20 nt, Artificial Sequence
  Guide Sequence
guauucuccaccacugcucc

SEQ ID NO: 31 - RNA, 20 nt, Artificial Sequence
  Guide Sequence
gucguucguggcuggaagga

SEQ ID NO: 32 - RNA, 20 nt, Artificial Sequence
  Guide Sequence
guggcuggaaggagcagugg

SEQ ID NO: 33 - RNA, 20 nt, Artificial Sequence
  Guide Sequence
guucguggcuggaaggagca

SEQ ID NO: 34 - RNA, 20 nt, Artificial Sequence
  Guide Sequence
uaguauucuccaccacugcu

SEQ ID NO: 35 - RNA, 20 nt, Artificial Sequence
  Guide Sequence
uauucuccaccacugcuccu

SEQ ID NO: 36 - RNA, 20 nt, Artificial Sequence
  Guide Sequence
ucauaguauucuccaccacu

SEQ ID NO: 37 - RNA, 20 nt, Artificial Sequence
  Guide Sequence
uccaccacugcuccuuccag

SEQ ID NO: 38 - RNA, 20 nt, Artificial Sequence
  Guide Sequence
ucguggcuggaaggagcagu

SEQ ID NO: 39 - RNA, 20 nt, Artificial Sequence
  Guide Sequence
ucguucguggcuggaaggag

SEQ ID NO: 40 - RNA, 20 nt, Artificial Sequence
  Guide Sequence
ucuccaccacugcuccuucc

SEQ ID NO: 41 - RNA, 20 nt, Artificial Sequence
  Guide Sequence
ugcgucguucguggcuggaa

SEQ ID NO: 42 - RNA, 20 nt, Artificial Sequence
  Guide Sequence
ugcuccuuccagccacgaac

SEQ ID NO: 43 - RNA, 20 nt, Artificial Sequence
  Guide Sequence
uggaaggagcagugguggag

SEQ ID NO: 44 - RNA, 20 nt, Artificial Sequence
  Guide Sequence
uggcuggaaggagcaguggu

SEQ ID NO: 45 - RNA, 20 nt, Artificial Sequence
  Guide Sequence
uucguggcuggaaggagcag

SEQ ID NO: 46 - RNA, 20 nt, Artificial Sequence
  Guide Sequence
uucuccaccacugcuccuuc

SEQ ID NO: 47 - RNA, 21 nt, Artificial Sequence
  Guide Sequence
aaggagcagugguggagaaua

SEQ ID NO: 48 - RNA, 21 nt, Artificial Sequence
  Guide Sequence
accacugcuccuuccagccac

SEQ ID NO: 49 - RNA, 21 nt, Artificial Sequence
  Guide Sequence
acugcuccuuccagccacgaa

SEQ ID NO: 50 - RNA, 21 nt, Artificial Sequence
  Guide Sequence
agcagugguggagaauacuau

SEQ ID NO: 51 - RNA, 21 nt, Artificial Sequence
  Guide Sequence
aggagcagugguggagaauac

SEQ ID NO: 52 - RNA, 21 nt, Artificial Sequence
  Guide Sequence
aguauucuccaccacugcucc

SEQ ID NO: 53 - RNA, 21 nt, Artificial Sequence
  Guide Sequence
auaguauucuccaccacugcu

SEQ ID NO: 54 - RNA, 21 nt, Artificial Sequence
  Guide Sequence
aucauaguauucuccaccacu

SEQ ID NO: 55 - RNA, 21 nt, Artificial Sequence
  Guide Sequence
auucuccaccacugcuccuuc

SEQ ID NO: 56 - RNA, 21 nt, Artificial Sequence
  Guide Sequence
caccacugcuccuuccagcca

SEQ ID NO: 57 - RNA, 21 nt, Artificial Sequence
  Guide Sequence
cacugcuccuuccagccacga

SEQ ID NO: 58 - RNA, 21 nt, Artificial Sequence
  Guide Sequence
cauaguauucuccaccacugc

SEQ ID NO: 59 - RNA, 21 nt, Artificial Sequence
  Guide Sequence
caucauaguauucuccaccac

SEQ ID NO: 60 - RNA, 21 nt, Artificial Sequence
  Guide Sequence
ccaccacugcuccuuccagcc

SEQ ID NO: 61 - RNA, 21 nt, Artificial Sequence
  Guide Sequence
ccacugcuccuuccagccacg

SEQ ID NO: 62 - RNA, 21 nt, Artificial Sequence
  Guide Sequence
ccaucauaguauucuccacca

SEQ ID NO: 63 - RNA, 21 nt, Artificial Sequence
  Guide Sequence
cgucguucguggcuggaagga

SEQ ID NO: 64 - RNA, 21 nt, Artificial Sequence
  Guide Sequence
cguggcuggaaggagcagugg

SEQ ID NO: 65 - RNA, 21 nt, Artificial Sequence
  Guide Sequence
cguucguggcuggaaggagca

SEQ ID NO: 66 - RNA, 21 nt, Artificial Sequence
  Guide Sequence
cuccaccacugcuccuuccag

SEQ ID NO: 67 - RNA, 21 nt, Artificial Sequence
  Guide Sequence
cugcuccuuccagccacgaac

SEQ ID NO: 68 - RNA, 21 nt, Artificial Sequence
  Guide Sequence
cuggaaggagcagugguggag

SEQ ID NO: 69 - RNA, 21 nt, Artificial Sequence
  Guide Sequence
gaaggagcagugguggagaau

SEQ ID NO: 70 - RNA, 21 nt, Artificial Sequence
  Guide Sequence
gagcagugguggagaauacua

SEQ ID NO: 71 - RNA, 21 nt, Artificial Sequence
  Guide Sequence
gcgucguucguggcuggaagg

SEQ ID NO: 72 - RNA, 21 nt, Artificial Sequence
  Guide Sequence
gcuccuuccagccacgaacga

SEQ ID NO: 73 - RNA, 21 nt, Artificial Sequence
  Guide Sequence
gcuggaaggagcaguggugga

SEQ ID NO: 74 - RNA, 21 nt, Artificial Sequence
  Guide Sequence
ggaaggagcagugguggagaa

SEQ ID NO: 75 - RNA, 21 nt, Artificial Sequence
  Guide Sequence
ggagcagugguggagaauacu

SEQ ID NO: 76 - RNA, 21 nt, Artificial Sequence
  Guide Sequence
ggcuggaaggagcaguggugg

SEQ ID NO: 77 - RNA, 21 nt, Artificial Sequence
  Guide Sequence
guauucuccaccacugcuccu

SEQ ID NO: 78 - RNA, 21 nt, Artificial Sequence
  Guide Sequence
gucguucguggcuggaaggag

SEQ ID NO: 79 - RNA, 21 nt, Artificial Sequence
  Guide Sequence
guggcuggaaggagcaguggu

SEQ ID NO: 80 - RNA, 21 nt, Artificial Sequence
  Guide Sequence
guucguggcuggaaggagcag

SEQ ID NO: 81 - RNA, 21 nt, Artificial Sequence
  Guide Sequence
uaguauucuccaccacugcuc

SEQ ID NO: 82 - RNA, 21 nt, Artificial Sequence
  Guide Sequence
uauucuccaccacugcuccuu

SEQ ID NO: 83 - RNA, 21 nt, Artificial Sequence
  Guide Sequence
ucauaguauucuccaccacug

SEQ ID NO: 84 - RNA, 21 nt, Artificial Sequence
  Guide Sequence
uccaccacugcuccuuccagc

SEQ ID NO: 85 - RNA, 21 nt, Artificial Sequence
  Guide Sequence
ucguggcuggaaggagcagug

SEQ ID NO: 86 - RNA, 21 nt, Artificial Sequence
  Guide Sequence
ucguucguggcuggaaggagc

SEQ ID NO: 87 - RNA, 21 nt, Artificial Sequence
  Guide Sequence
ucuccaccacugcuccuucca

SEQ ID NO: 88 - RNA, 21 nt, Artificial Sequence
  Guide Sequence
ugcgucguucguggcuggaag

SEQ ID NO: 89 - RNA, 21 nt, Artificial Sequence
  Guide Sequence
ugcuccuuccagccacgaacg

SEQ ID NO: 90 - RNA, 21 nt, Artificial Sequence
  Guide Sequence
uggaaggagcagugguggaga

SEQ ID NO: 91 - RNA, 21 nt, Artificial Sequence
  Guide Sequence
uggcuggaaggagcaguggug

SEQ ID NO: 92 - RNA, 21 nt, Artificial Sequence
  Guide Sequence
uucguggcuggaaggagcagu

SEQ ID NO: 93 - RNA, 21 nt, Artificial Sequence
  Guide Sequence
uucuccaccacugcuccuucc

SEQ ID NO: 94 - RNA, 21 nt, Artificial Sequence
  Guide Sequence
uugcgucguucguggcuggaa

SEQ ID NO: 95 - RNA, 22 nt, Artificial Sequence
  Guide Sequence
aaggagcagugguggagaauac

SEQ ID NO: 96 - RNA, 22 nt, Artificial Sequence
  Guide Sequence
accacugcuccuuccagccacg

SEQ ID NO: 97 - RNA, 22 nt, Artificial Sequence
  Guide Sequence
acugcuccuuccagccacgaac

SEQ ID NO: 98 - RNA, 22 nt, Artificial Sequence
  Guide Sequence
agcagugguggagaauacuaug

SEQ ID NO: 99 - RNA, 22 nt, Artificial Sequence
  Guide Sequence
aggagcagugguggagaauacu

SEQ ID NO: 100 - RNA, 22 nt, Artificial Sequence
  Guide Sequence
aguauucuccaccacugcuccu

SEQ ID NO: 101 - RNA, 22 nt, Artificial Sequence
  Guide Sequence
auaguauucuccaccacugcuc

SEQ ID NO: 102 - RNA, 22 nt, Artificial Sequence
  Guide Sequence
aucauaguauucuccaccacug

SEQ ID NO: 103 - RNA, 22 nt, Artificial Sequence
  Guide Sequence
auucuccaccacugcuccuucc

SEQ ID NO: 104 - RNA, 22 nt, Artificial Sequence
  Guide Sequence
caccacugcuccuuccagccac

SEQ ID NO: 105 - RNA, 22 nt, Artificial Sequence
  Guide Sequence
cacugcuccuuccagccacgaa

SEQ ID NO: 106 - RNA, 22 nt, Artificial Sequence
  Guide Sequence
cauaguauucuccaccacugcu

SEQ ID NO: 107 - RNA, 22 nt, Artificial Sequence
  Guide Sequence
caucauaguauucuccaccacu

SEQ ID NO: 108 - RNA, 22 nt, Artificial Sequence
  Guide Sequence
ccaccacugcuccuuccagcca

SEQ ID NO: 109 - RNA, 22 nt, Artificial Sequence
  Guide Sequence
ccacugcuccuuccagccacga

SEQ ID NO: 110 - RNA, 22 nt, Artificial Sequence
  Guide Sequence
ccaucauaguauucuccaccac

SEQ ID NO: 111 - RNA, 22 nt, Artificial Sequence
  Guide Sequence
cgucguucguggcuggaaggag

SEQ ID NO: 112 - RNA, 22 nt, Artificial Sequence
  Guide Sequence
cguggcuggaaggagcaguggu

SEQ ID NO: 113 - RNA, 22 nt, Artificial Sequence
  Guide Sequence
cguucguggcuggaaggagcag

SEQ ID NO: 114 - RNA, 22 nt, Artificial Sequence
  Guide Sequence
cuccaccacugcuccuuccagc

SEQ ID NO: 115 - RNA, 22 nt, Artificial Sequence
  Guide Sequence
cugcuccuuccagccacgaacg

SEQ ID NO: 116 - RNA, 22 nt, Artificial Sequence
  Guide Sequence
cuggaaggagcagugguggaga

SEQ ID NO: 117 - RNA, 22 nt, Artificial Sequence
  Guide Sequence
gaaggagcagugguggagaaua

SEQ ID NO: 118 - RNA, 22 nt, Artificial Sequence
  Guide Sequence
gagcagugguggagaauacuau

SEQ ID NO: 119 - RNA, 22 nt, Artificial Sequence
  Guide Sequence
gccaucauaguauucuccacca

SEQ ID NO: 120 - RNA, 22 nt, Artificial Sequence
  Guide Sequence
gcgucguucguggcuggaagga

SEQ ID NO: 121 - RNA, 22 nt, Artificial Sequence
  Guide Sequence
gcuccuuccagccacgaacgac

SEQ ID NO: 122 - RNA, 22 nt, Artificial Sequence
  Guide Sequence
gcuggaaggagcagugguggag

SEQ ID NO: 123 - RNA, 22 nt, Artificial Sequence
  Guide Sequence
ggaaggagcagugguggagaau

SEQ ID NO: 124 - RNA, 22 nt, Artificial Sequence
  Guide Sequence
ggagcagugguggagaauacua

SEQ ID NO: 125 - RNA, 22 nt, Artificial Sequence
  Guide Sequence
ggcuggaaggagcaguggugga

SEQ ID NO: 126 - RNA, 22 nt, Artificial Sequence
  Guide Sequence
guauucuccaccacugcuccuu

SEQ ID NO: 127 - RNA, 22 nt, Artificial Sequence
  Guide Sequence
gucguucguggcuggaaggagc

SEQ ID NO: 128 - RNA, 22 nt, Artificial Sequence
  Guide Sequence
guggcuggaaggagcaguggug

SEQ ID NO: 129 - RNA, 22 nt, Artificial Sequence
  Guide Sequence
guucguggcuggaaggagcagu

SEQ ID NO: 130 - RNA, 22 nt, Artificial Sequence
  Guide Sequence
uaguauucuccaccacugcucc

SEQ ID NO: 131 - RNA, 22 nt, Artificial Sequence
  Guide Sequence
uauucuccaccacugcuccuuc

SEQ ID NO: 132 - RNA, 22 nt, Artificial Sequence
  Guide Sequence
ucauaguauucuccaccacugc

SEQ ID NO: 133 - RNA, 22 nt, Artificial Sequence
  Guide Sequence
uccaccacugcuccuuccagcc

SEQ ID NO: 134 - RNA, 22 nt, Artificial Sequence
  Guide Sequence
ucguggcuggaaggagcagugg

SEQ ID NO: 135 - RNA, 22 nt, Artificial Sequence
  Guide Sequence
ucguucguggcuggaaggagca

SEQ ID NO: 136 - RNA, 22 nt, Artificial Sequence
  Guide Sequence
ucuccaccacugcuccuuccag

SEQ ID NO: 137 - RNA, 22 nt, Artificial Sequence
  Guide Sequence
ugcgucguucguggcuggaagg

SEQ ID NO: 138 - RNA, 22 nt, Artificial Sequence
  Guide Sequence
ugcuccuuccagccacgaacga

SEQ ID NO: 139 - RNA, 22 nt, Artificial Sequence
  Guide Sequence
uggaaggagcagugguggagaa

SEQ ID NO: 140 - RNA, 22 nt, Artificial Sequence
  Guide Sequence
uggcuggaaggagcaguggugg

SEQ ID NO: 141 - RNA, 22 nt, Artificial Sequence
  Guide Sequence
uucguggcuggaaggagcagug

SEQ ID NO: 142 - RNA, 22 nt, Artificial Sequence
  Guide Sequence
uucuccaccacugcuccuucca

SEQ ID NO: 143 - RNA, 22 nt, Artificial Sequence
  Guide Sequence
uugcgucguucguggcuggaag

SEQ ID NO: 144 - RNA, 22 nt, Artificial Sequence
  Guide Sequence
uuugcgucguucguggcuggaa

SEQ ID NO: 145 - RNA, 20 nt, Artificial Sequence
  Guide Sequence
aaagcuccuguucggagcug

SEQ ID NO: 146 - RNA, 20 nt, Artificial Sequence
  Guide Sequence
aacaggagcuuucuauccuc

SEQ ID NO: 147 - RNA, 20 nt, Artificial Sequence
  Guide Sequence
aauagagagaggauagaaag

SEQ ID NO: 148 - RNA, 20 nt, Artificial Sequence
  Guide Sequence
acaggagcuuucuauccucu

SEQ ID NO: 149 - RNA, 20 nt, Artificial Sequence
  Guide Sequence
agaaagcuccuguucggagc

SEQ ID NO: 150 - RNA, 20 nt, Artificial Sequence
  Guide Sequence
agagagaggauagaaagcuc

SEQ ID NO: 151 - RNA, 20 nt, Artificial Sequence
  Guide Sequence
agagaggauagaaagcuccu

SEQ ID NO: 152 - RNA, 20 nt, Artificial Sequence
  Guide Sequence
agaggauagaaagcuccugu

SEQ ID NO: 153 - RNA, 20 nt, Artificial Sequence
  Guide Sequence
agcuccgaacaggagcuuuc

SEQ ID NO: 154 - RNA, 20 nt, Artificial Sequence
  Guide Sequence
agcuuucuauccucucucua

SEQ ID NO: 155 - RNA, 20 nt, Artificial Sequence
  Guide Sequence
aggagcuuucuauccucucu

SEQ ID NO: 156 - RNA, 20 nt, Artificial Sequence
  Guide Sequence
aggauagaaagcuccuguuc

SEQ ID NO: 157 - RNA, 20 nt, Artificial Sequence
  Guide Sequence
aguguaauagagagaggaua

SEQ ID NO: 158 - RNA, 20 nt, Artificial Sequence
  Guide Sequence
auagaaagcuccuguucgga

SEQ ID NO: 159 - RNA, 20 nt, Artificial Sequence
  Guide Sequence
auagagagaggauagaaagc

SEQ ID NO: 160 - RNA, 20 nt, Artificial Sequence
  Guide Sequence
cagcuccgaacaggagcuuu

SEQ ID NO: 161 - RNA, 20 nt, Artificial Sequence
  Guide Sequence
caggagcuuucuauccucuc

SEQ ID NO: 162 - RNA, 20 nt, Artificial Sequence
  Guide Sequence
ccagcuccgaacaggagcuu

SEQ ID NO: 163 - RNA, 20 nt, Artificial Sequence
  Guide Sequence
cccagcuccgaacaggagcu

SEQ ID NO: 164 - RNA, 20 nt, Artificial Sequence
  Guide Sequence
ccccagcuccgaacaggagc

SEQ ID NO: 165 - RNA, 20 nt, Artificial Sequence
  Guide Sequence
cccccagcuccgaacaggag

SEQ ID NO: 166 - RNA, 20 nt, Artificial Sequence
  Guide Sequence
ccgaacaggagcuuucuauc

SEQ ID NO: 167 - RNA, 20 nt, Artificial Sequence
  Guide Sequence
cgaacaggagcuuucuaucc

SEQ ID NO: 168 - RNA, 20 nt, Artificial Sequence
  Guide Sequence
cuccgaacaggagcuuucua

SEQ ID NO: 169 - RNA, 20 nt, Artificial Sequence
  Guide Sequence
cuuucuauccucucucuauu

SEQ ID NO: 170 - RNA, 20 nt, Artificial Sequence
  Guide Sequence
gaaagcuccuguucggagcu

SEQ ID NO: 171 - RNA, 20 nt, Artificial Sequence
  Guide Sequence
gaacaggagcuuucuauccu

SEQ ID NO: 172 - RNA, 20 nt, Artificial Sequence
  Guide Sequence
gagagaggauagaaagcucc

SEQ ID NO: 173 - RNA, 20 nt, Artificial Sequence
  Guide Sequence
gagaggauagaaagcuccug

SEQ ID NO: 174 - RNA, 20 nt, Artificial Sequence
  Guide Sequence
gagcuuucuauccucucucu

SEQ ID NO: 175 - RNA, 20 nt, Artificial Sequence
  Guide Sequence
gaggauagaaagcuccuguu

SEQ ID NO: 176 - RNA, 20 nt, Artificial Sequence
  Guide Sequence
gaguguaauagagagaggau

SEQ ID NO: 177 - RNA, 20 nt, Artificial Sequence
  Guide Sequence
gauagaaagcuccuguucgg

SEQ ID NO: 178 - RNA, 20 nt, Artificial Sequence
  Guide Sequence
gcuccgaacaggagcuuucu

SEQ ID NO: 179 - RNA, 20 nt, Artificial Sequence
  Guide Sequence
gcuuucuauccucucucuau

SEQ ID NO: 180 - RNA, 20 nt, Artificial Sequence
  Guide Sequence
ggagcuuucuauccucucuc

SEQ ID NO: 181 - RNA, 20 nt, Artificial Sequence
  Guide Sequence
ggauagaaagcuccuguucg

SEQ ID NO: 182 - RNA, 20 nt, Artificial Sequence
  Guide Sequence
guaauagagagaggauagaa

SEQ ID NO: 183 - RNA, 20 nt, Artificial Sequence
  Guide Sequence
guguaauagagagaggauag

SEQ ID NO: 184 - RNA, 20 nt, Artificial Sequence
  Guide Sequence
uaauagagagaggauagaaa

SEQ ID NO: 185 - RNA, 20 nt, Artificial Sequence
  Guide Sequence
uagaaagcuccuguucggag

SEQ ID NO: 186 - RNA, 20 nt, Artificial Sequence
  Guide Sequence
uagagagaggauagaaagcu

SEQ ID NO: 187 - RNA, 20 nt, Artificial Sequence
  Guide Sequence
ucccccagcuccgaacagga

SEQ ID NO: 188 - RNA, 20 nt, Artificial Sequence
  Guide Sequence
uccgaacaggagcuuucuau

SEQ ID NO: 189 - RNA, 20 nt, Artificial Sequence
  Guide Sequence
uguaauagagagaggauaga

SEQ ID NO: 190 - RNA, 20 nt, Artificial Sequence
  Guide Sequence
uuucuauccucucucuauua

SEQ ID NO: 191 - RNA, 21 nt, Artificial Sequence
  Guide Sequence
aaagcuccuguucggagcugg

SEQ ID NO: 192 - RNA, 21 nt, Artificial Sequence
  Guide Sequence
aacaggagcuuucuauccucu

SEQ ID NO: 193 - RNA, 21 nt, Artificial Sequence
  Guide Sequence
aauagagagaggauagaaagc

SEQ ID NO: 194 - RNA, 21 nt, Artificial Sequence
  Guide Sequence
acaggagcuuucuauccucuc

SEQ ID NO: 195 - RNA, 21 nt, Artificial Sequence
  Guide Sequence
agaaagcuccuguucggagcu

SEQ ID NO: 196 - RNA, 21 nt, Artificial Sequence
  Guide Sequence
agagagaggauagaaagcucc

SEQ ID NO: 197 - RNA, 21 nt, Artificial Sequence
  Guide Sequence
agagaggauagaaagcuccug

SEQ ID NO: 198 - RNA, 21 nt, Artificial Sequence
  Guide Sequence
agaggauagaaagcuccuguu

SEQ ID NO: 199 - RNA, 21 nt, Artificial Sequence
  Guide Sequence
agcuccgaacaggagcuuucu

SEQ ID NO: 200 - RNA, 21 nt, Artificial Sequence
  Guide Sequence
agcuuucuauccucucucuau

SEQ ID NO: 201 - RNA, 21 nt, Artificial Sequence
  Guide Sequence
aggagcuuucuauccucucuc

SEQ ID NO: 202 - RNA, 21 nt, Artificial Sequence
  Guide Sequence
aggauagaaagcuccuguucg

SEQ ID NO: 203 - RNA, 21 nt, Artificial Sequence
  Guide Sequence
aguguaauagagagaggauag

SEQ ID NO: 204 - RNA, 21 nt, Artificial Sequence
  Guide Sequence
auagaaagcuccuguucggag

SEQ ID NO: 205 - RNA, 21 nt, Artificial Sequence
  Guide Sequence
auagagagaggauagaaagcu

SEQ ID NO: 206 - RNA, 21 nt, Artificial Sequence
  Guide Sequence
cagcuccgaacaggagcuuuc

SEQ ID NO: 207 - RNA, 21 nt, Artificial Sequence
  Guide Sequence
caggagcuuucuauccucucu

SEQ ID NO: 208 - RNA, 21 nt, Artificial Sequence
  Guide Sequence
ccagcuccgaacaggagcuuu

SEQ ID NO: 209 - RNA, 21 nt, Artificial Sequence
  Guide Sequence
cccagcuccgaacaggagcuu

SEQ ID NO: 210 - RNA, 21 nt, Artificial Sequence
  Guide Sequence
ccccagcuccgaacaggagcu

SEQ ID NO: 211 - RNA, 21 nt, Artificial Sequence
  Guide Sequence
cccccagcuccgaacaggagc

SEQ ID NO: 212 - RNA, 21 nt, Artificial Sequence
  Guide Sequence
ccgaacaggagcuuucuaucc

SEQ ID NO: 213 - RNA, 21 nt, Artificial Sequence
  Guide Sequence
cgaacaggagcuuucuauccu

SEQ ID NO: 214 - RNA, 21 nt, Artificial Sequence
  Guide Sequence
cuccgaacaggagcuuucuau

SEQ ID NO: 215 - RNA, 21 nt, Artificial Sequence
  Guide Sequence
cuuucuauccucucucuauua

SEQ ID NO: 216 - RNA, 21 nt, Artificial Sequence
  Guide Sequence
gaaagcuccuguucggagcug

SEQ ID NO: 217 - RNA, 21 nt, Artificial Sequence
  Guide Sequence
gaacaggagcuuucuauccuc

SEQ ID NO: 218 - RNA, 21 nt, Artificial Sequence
  Guide Sequence
gagagaggauagaaagcuccu

SEQ ID NO: 219 - RNA, 21 nt, Artificial Sequence
  Guide Sequence
gagaggauagaaagcuccugu

SEQ ID NO: 220 - RNA, 21 nt, Artificial Sequence
  Guide Sequence
gagcuuucuauccucucucua

SEQ ID NO: 221 - RNA, 21 nt, Artificial Sequence
  Guide Sequence
gaggauagaaagcuccuguuc

SEQ ID NO: 222 - RNA, 21 nt, Artificial Sequence
  Guide Sequence
gaguguaauagagagaggaua

SEQ ID NO: 223 - RNA, 21 nt, Artificial Sequence
  Guide Sequence
gauagaaagcuccuguucgga

SEQ ID NO: 224 - RNA, 21 nt, Artificial Sequence
  Guide Sequence
gcuccgaacaggagcuuucua

SEQ ID NO: 225 - RNA, 21 nt, Artificial Sequence
  Guide Sequence
gcuuucuauccucucucuauu

SEQ ID NO: 226 - RNA, 21 nt, Artificial Sequence
  Guide Sequence
ggagcuuucuauccucucucu

SEQ ID NO: 227 - RNA, 21 nt, Artificial Sequence
  Guide Sequence
ggaguguaauagagagaggau

SEQ ID NO: 228 - RNA, 21 nt, Artificial Sequence
  Guide Sequence
ggauagaaagcuccuguucgg

SEQ ID NO: 229 - RNA, 21 nt, Artificial Sequence
  Guide Sequence
guaauagagagaggauagaaa

SEQ ID NO: 230 - RNA, 21 nt, Artificial Sequence
  Guide Sequence
guguaauagagagaggauaga

SEQ ID NO: 231 - RNA, 21 nt, Artificial Sequence
  Guide Sequence
uaauagagagaggauagaaag

SEQ ID NO: 232 - RNA, 21 nt, Artificial Sequence
  Guide Sequence
uagaaagcuccuguucggagc

SEQ ID NO: 233 - RNA, 21 nt, Artificial Sequence
  Guide Sequence
uagagagaggauagaaagcuc

SEQ ID NO: 234 - RNA, 21 nt, Artificial Sequence
  Guide Sequence
ucccccagcuccgaacaggag

SEQ ID NO: 235 - RNA, 21 nt, Artificial Sequence
  Guide Sequence
uccgaacaggagcuuucuauc

SEQ ID NO: 236 - RNA, 21 nt, Artificial Sequence
  Guide Sequence
uguaauagagagaggauagaa

SEQ ID NO: 237 - RNA, 21 nt, Artificial Sequence
  Guide Sequence
uucccccagcuccgaacagga

SEQ ID NO: 238 - RNA, 21 nt, Artificial Sequence
  Guide Sequence
uuucuauccucucucuauuac

SEQ ID NO: 239 - RNA, 22 nt, Artificial Sequence
  Guide Sequence
aaagcuccuguucggagcuggg

SEQ ID NO: 240 - RNA, 22 nt, Artificial Sequence
  Guide Sequence
aacaggagcuuucuauccucuc

SEQ ID NO: 241 - RNA, 22 nt, Artificial Sequence
  Guide Sequence
aauagagagaggauagaaagcu

SEQ ID NO: 242 - RNA, 22 nt, Artificial Sequence
  Guide Sequence
acaggagcuuucuauccucucu

SEQ ID NO: 243 - RNA, 22 nt, Artificial Sequence
  Guide Sequence
agaaagcuccuguucggagcug

SEQ ID NO: 244 - RNA, 22 nt, Artificial Sequence
  Guide Sequence
agagagaggauagaaagcuccu

SEQ ID NO: 245 - RNA, 22 nt, Artificial Sequence
  Guide Sequence
agagaggauagaaagcuccugu

SEQ ID NO: 246 - RNA, 22 nt, Artificial Sequence
  Guide Sequence
agaggauagaaagcuccuguuc

SEQ ID NO: 247 - RNA, 22 nt, Artificial Sequence
  Guide Sequence
agcuccgaacaggagcuuucua

SEQ ID NO: 248 - RNA, 22 nt, Artificial Sequence
  Guide Sequence
agcuuucuauccucucucuauu

SEQ ID NO: 249 - RNA, 22 nt, Artificial Sequence
  Guide Sequence
aggagcuuucuauccucucucu

SEQ ID NO: 250 - RNA, 22 nt, Artificial Sequence
  Guide Sequence
aggauagaaagcuccuguucgg

SEQ ID NO: 251 - RNA, 22 nt, Artificial Sequence
  Guide Sequence
aguguaauagagagaggauaga

SEQ ID NO: 252 - RNA, 22 nt, Artificial Sequence
  Guide Sequence
auagaaagcuccuguucggagc

SEQ ID NO: 253 - RNA, 22 nt, Artificial Sequence
  Guide Sequence
auagagagaggauagaaagcuc

SEQ ID NO: 254 - RNA, 22 nt, Artificial Sequence
  Guide Sequence
cagcuccgaacaggagcuuucu

SEQ ID NO: 255 - RNA, 22 nt, Artificial Sequence
  Guide Sequence
caggagcuuucuauccucucuc

SEQ ID NO: 256 - RNA, 22 nt, Artificial Sequence
  Guide Sequence
ccagcuccgaacaggagcuuuc

SEQ ID NO: 257 - RNA, 22 nt, Artificial Sequence
  Guide Sequence
cccagcuccgaacaggagcuuu

SEQ ID NO: 258 - RNA, 22 nt, Artificial Sequence
  Guide Sequence
ccccagcuccgaacaggagcuu

SEQ ID NO: 259 - RNA, 22 nt, Artificial Sequence
  Guide Sequence
cccccagcuccgaacaggagcu

SEQ ID NO: 260 - RNA, 22 nt, Artificial Sequence
  Guide Sequence
ccgaacaggagcuuucuauccu

SEQ ID NO: 261 - RNA, 22 nt, Artificial Sequence
  Guide Sequence
cgaacaggagcuuucuauccuc

SEQ ID NO: 262 - RNA, 22 nt, Artificial Sequence
  Guide Sequence
cggaguguaauagagagaggau

SEQ ID NO: 263 - RNA, 22 nt, Artificial Sequence
  Guide Sequence
cuccgaacaggagcuuucuauc

SEQ ID NO: 264 - RNA, 22 nt, Artificial Sequence
  Guide Sequence
cuuucuauccucucucuauuac

SEQ ID NO: 265 - RNA, 22 nt, Artificial Sequence
  Guide Sequence
gaaagcuccuguucggagcugg

SEQ ID NO: 266 - RNA, 22 nt, Artificial Sequence
  Guide Sequence
gaacaggagcuuucuauccucu

SEQ ID NO: 267 - RNA, 22 nt, Artificial Sequence
  Guide Sequence
gagagaggauagaaagcuccug

SEQ ID NO: 268 - RNA, 22 nt, Artificial Sequence
  Guide Sequence
gagaggauagaaagcuccuguu

SEQ ID NO: 269 - RNA, 22 nt, Artificial Sequence
  Guide Sequence
gagcuuucuauccucucucuau

SEQ ID NO: 270 - RNA, 22 nt, Artificial Sequence
  Guide Sequence
gaggauagaaagcuccuguucg

SEQ ID NO: 271 - RNA, 22 nt, Artificial Sequence
  Guide Sequence
gaguguaauagagagaggauag

SEQ ID NO: 272 - RNA, 22 nt, Artificial Sequence
  Guide Sequence
gauagaaagcuccuguucggag

SEQ ID NO: 273 - RNA, 22 nt, Artificial Sequence
  Guide Sequence
gcuccgaacaggagcuuucuau

SEQ ID NO: 274 - RNA, 22 nt, Artificial Sequence
  Guide Sequence
gcuuucuauccucucucuauua

SEQ ID NO: 275 - RNA, 22 nt, Artificial Sequence
  Guide Sequence
ggagcuuucuauccucucucua

SEQ ID NO: 276 - RNA, 22 nt, Artificial Sequence
  Guide Sequence
ggaguguaauagagagaggaua

SEQ ID NO: 277 - RNA, 22 nt, Artificial Sequence
  Guide Sequence
ggauagaaagcuccuguucgga

SEQ ID NO: 278 - RNA, 22 nt, Artificial Sequence
  Guide Sequence
guaauagagagaggauagaaag

SEQ ID NO: 279 - RNA, 22 nt, Artificial Sequence
  Guide Sequence
guguaauagagagaggauagaa

SEQ ID NO: 280 - RNA, 22 nt, Artificial Sequence
  Guide Sequence
guucccccagcuccgaacagga

SEQ ID NO: 281 - RNA, 22 nt, Artificial Sequence
  Guide Sequence
uaauagagagaggauagaaagc

SEQ ID NO: 282 - RNA, 22 nt, Artificial Sequence
  Guide Sequence
uagaaagcuccuguucggagcu

SEQ ID NO: 283 - RNA, 22 nt, Artificial Sequence
  Guide Sequence
uagagagaggauagaaagcucc

SEQ ID NO: 284 - RNA, 22 nt, Artificial Sequence
  Guide Sequence
ucccccagcuccgaacaggagc

SEQ ID NO: 285 - RNA, 22 nt, Artificial Sequence
  Guide Sequence
uccgaacaggagcuuucuaucc

SEQ ID NO: 286 - RNA, 22 nt, Artificial Sequence
  Guide Sequence
uguaauagagagaggauagaaa

SEQ ID NO: 287 - RNA, 22 nt, Artificial Sequence
  Guide Sequence
uucccccagcuccgaacaggag

SEQ ID NO: 288 - RNA, 22 nt, Artificial Sequence
  Guide Sequence
uuucuauccucucucuauuaca

SEQ ID NO: 289 - RNA, 20 nt, Artificial Sequence
  Guide Sequence
aaaguucguacccgccuaga

SEQ ID NO: 290 - RNA, 20 nt, Artificial Sequence
  Guide Sequence
aaguucguacccgccuagag

SEQ ID NO: 291 - RNA, 20 nt, Artificial Sequence
  Guide Sequence
acacccuccccucuaggcgg

SEQ ID NO: 292 - RNA, 20 nt, Artificial Sequence
  Guide Sequence
acccuccccucuaggcgggu

SEQ ID NO: 293 - RNA, 20 nt, Artificial Sequence
  Guide Sequence
agacacccuccccucuaggc

SEQ ID NO: 294 - RNA, 20 nt, Artificial Sequence
  Guide Sequence
aggcggguacgaacuuucgc

SEQ ID NO: 295 - RNA, 20 nt, Artificial Sequence
  Guide Sequence
agggcgaaaguucguacccg

SEQ ID NO: 296 - RNA, 20 nt, Artificial Sequence
  Guide Sequence
aguucguacccgccuagagg

SEQ ID NO: 297 - RNA, 20 nt, Artificial Sequence
  Guide Sequence
cacccuccccucuaggcggg

SEQ ID NO: 298 - RNA, 20 nt, Artificial Sequence
  Guide Sequence
cagggcgaaaguucguaccc

SEQ ID NO: 299 - RNA, 20 nt, Artificial Sequence
  Guide Sequence
ccccucuaggcggguacgaa

SEQ ID NO: 300 - RNA, 20 nt, Artificial Sequence
  Guide Sequence
cccuccccucuaggcgggua

SEQ ID NO: 301 - RNA, 20 nt, Artificial Sequence
  Guide Sequence
cccucuaggcggguacgaac

SEQ ID NO: 302 - RNA, 20 nt, Artificial Sequence
  Guide Sequence
ccuccccucuaggcggguac

SEQ ID NO: 303 - RNA, 20 nt, Artificial Sequence
  Guide Sequence
ccucuaggcggguacgaacu

SEQ ID NO: 304 - RNA, 20 nt, Artificial Sequence
  Guide Sequence
ccucucucagggcgaaaguu

SEQ ID NO: 305 - RNA, 20 nt, Artificial Sequence
  Guide Sequence
cgaaaguucguacccgccua

SEQ ID NO: 306 - RNA, 20 nt, Artificial Sequence
  Guide Sequence
cggguacgaacuuucgcccu

SEQ ID NO: 307 - RNA, 20 nt, Artificial Sequence
  Guide Sequence
cguacccgccuagaggggag

SEQ ID NO: 308 - RNA, 20 nt, Artificial Sequence
  Guide Sequence
cuaggcggguacgaacuuuc

SEQ ID NO: 309 - RNA, 20 nt, Artificial Sequence
  Guide Sequence
cucagggcgaaaguucguac

SEQ ID NO: 310 - RNA, 20 nt, Artificial Sequence
  Guide Sequence
cuccccucuaggcggguacg

SEQ ID NO: 311 - RNA, 20 nt, Artificial Sequence
  Guide Sequence
cucuaggcggguacgaacuu

SEQ ID NO: 312 - RNA, 20 nt, Artificial Sequence
  Guide Sequence
cucucagggcgaaaguucgu

SEQ ID NO: 313 - RNA, 20 nt, Artificial Sequence
  Guide Sequence
cucucucagggcgaaaguuc

SEQ ID NO: 314 - RNA, 20 nt, Artificial Sequence
  Guide Sequence
gaaaguucguacccgccuag

SEQ ID NO: 315 - RNA, 20 nt, Artificial Sequence
  Guide Sequence
gacacccuccccucuaggcg

SEQ ID NO: 316 - RNA, 20 nt, Artificial Sequence
  Guide Sequence
gcgaaaguucguacccgccu

SEQ ID NO: 317 - RNA, 20 nt, Artificial Sequence
  Guide Sequence
gcggguacgaacuuucgccc

SEQ ID NO: 318 - RNA, 20 nt, Artificial Sequence
  Guide Sequence
ggcgaaaguucguacccgcc

SEQ ID NO: 319 - RNA, 20 nt, Artificial Sequence
  Guide Sequence
ggcggguacgaacuuucgcc

SEQ ID NO: 320 - RNA, 20 nt, Artificial Sequence
  Guide Sequence
gggcgaaaguucguacccgc

SEQ ID NO: 321 - RNA, 20 nt, Artificial Sequence
  Guide Sequence
ggguacgaacuuucgcccug

SEQ ID NO: 322 - RNA, 20 nt, Artificial Sequence
  Guide Sequence
gguacgaacuuucgcccuga

SEQ ID NO: 323 - RNA, 20 nt, Artificial Sequence
  Guide Sequence
guacccgccuagaggggagg

SEQ ID NO: 324 - RNA, 20 nt, Artificial Sequence
  Guide Sequence
guacgaacuuucgcccugag

SEQ ID NO: 325 - RNA, 20 nt, Artificial Sequence
  Guide Sequence
guucguacccgccuagaggg

SEQ ID NO: 326 - RNA, 20 nt, Artificial Sequence
  Guide Sequence
uacccgccuagaggggaggg

SEQ ID NO: 327 - RNA, 20 nt, Artificial Sequence
  Guide Sequence
uaggcggguacgaacuuucg

SEQ ID NO: 328 - RNA, 20 nt, Artificial Sequence
  Guide Sequence
ucagggcgaaaguucguacc

SEQ ID NO: 329 - RNA, 20 nt, Artificial Sequence
  Guide Sequence
uccccucuaggcggguacga

SEQ ID NO: 330 - RNA, 20 nt, Artificial Sequence
  Guide Sequence
ucguacccgccuagagggga

SEQ ID NO: 331 - RNA, 20 nt, Artificial Sequence
  Guide Sequence
ucuaggcggguacgaacuuu

SEQ ID NO: 332 - RNA, 20 nt, Artificial Sequence
  Guide Sequence
ucucagggcgaaaguucgua

SEQ ID NO: 333 - RNA, 20 nt, Artificial Sequence
  Guide Sequence
ucucucagggcgaaaguucg

SEQ ID NO: 334 - RNA, 20 nt, Artificial Sequence
  Guide Sequence
uucguacccgccuagagggg

SEQ ID NO: 335 - RNA, 21 nt, Artificial Sequence
  Guide Sequence
aaaguucguacccgccuagag

SEQ ID NO: 336 - RNA, 21 nt, Artificial Sequence
  Guide Sequence
aaguucguacccgccuagagg

SEQ ID NO: 337 - RNA, 21 nt, Artificial Sequence
  Guide Sequence
acacccuccccucuaggcggg

SEQ ID NO: 338 - RNA, 21 nt, Artificial Sequence
  Guide Sequence
acccuccccucuaggcgggua

SEQ ID NO: 339 - RNA, 21 nt, Artificial Sequence
  Guide Sequence
agacacccuccccucuaggcg

SEQ ID NO: 340 - RNA, 21 nt, Artificial Sequence
  Guide Sequence
aggcggguacgaacuuucgcc

SEQ ID NO: 341 - RNA, 21 nt, Artificial Sequence
  Guide Sequence
agggcgaaaguucguacccgc

SEQ ID NO: 342 - RNA, 21 nt, Artificial Sequence
  Guide Sequence
aguucguacccgccuagaggg

SEQ ID NO: 343 - RNA, 21 nt, Artificial Sequence
  Guide Sequence
cacccuccccucuaggcgggu

SEQ ID NO: 344 - RNA, 21 nt, Artificial Sequence
  Guide Sequence
cagggcgaaaguucguacccg

SEQ ID NO: 345 - RNA, 21 nt, Artificial Sequence
  Guide Sequence
ccccucuaggcggguacgaac

SEQ ID NO: 346 - RNA, 21 nt, Artificial Sequence
  Guide Sequence
cccuccccucuaggcggguac

SEQ ID NO: 347 - RNA, 21 nt, Artificial Sequence
  Guide Sequence
cccucuaggcggguacgaacu

SEQ ID NO: 348 - RNA, 21 nt, Artificial Sequence
  Guide Sequence
ccuccccucuaggcggguacg

SEQ ID NO: 349 - RNA, 21 nt, Artificial Sequence
  Guide Sequence
ccucuaggcggguacgaacuu

SEQ ID NO: 350 - RNA, 21 nt, Artificial Sequence
  Guide Sequence
ccucucucagggcgaaaguuc

SEQ ID NO: 351 - RNA, 21 nt, Artificial Sequence
  Guide Sequence
cgaaaguucguacccgccuag

SEQ ID NO: 352 - RNA, 21 nt, Artificial Sequence
  Guide Sequence
cggguacgaacuuucgcccug

SEQ ID NO: 353 - RNA, 21 nt, Artificial Sequence
  Guide Sequence
cguacccgccuagaggggagg

SEQ ID NO: 354 - RNA, 21 nt, Artificial Sequence
  Guide Sequence
cuaggcggguacgaacuuucg

SEQ ID NO: 355 - RNA, 21 nt, Artificial Sequence
  Guide Sequence
cucagggcgaaaguucguacc

SEQ ID NO: 356 - RNA, 21 nt, Artificial Sequence
  Guide Sequence
cuccccucuaggcggguacga

SEQ ID NO: 357 - RNA, 21 nt, Artificial Sequence
  Guide Sequence
cucuaggcggguacgaacuuu

SEQ ID NO: 358 - RNA, 21 nt, Artificial Sequence
  Guide Sequence
cucucagggcgaaaguucgua

SEQ ID NO: 359 - RNA, 21 nt, Artificial Sequence
  Guide Sequence
cucucucagggcgaaaguucg

SEQ ID NO: 360 - RNA, 21 nt, Artificial Sequence
  Guide Sequence
gaaaguucguacccgccuaga

SEQ ID NO: 361 - RNA, 21 nt, Artificial Sequence
  Guide Sequence
gacacccuccccucuaggcgg

SEQ ID NO: 362 - RNA, 21 nt, Artificial Sequence
  Guide Sequence
gccucucucagggcgaaaguu

SEQ ID NO: 363 - RNA, 21 nt, Artificial Sequence
  Guide Sequence
gcgaaaguucguacccgccua

SEQ ID NO: 364 - RNA, 21 nt, Artificial Sequence
  Guide Sequence
gcggguacgaacuuucgcccu

SEQ ID NO: 365 - RNA, 21 nt, Artificial Sequence
  Guide Sequence
ggcgaaaguucguacccgccu

SEQ ID NO: 366 - RNA, 21 nt, Artificial Sequence
  Guide Sequence
ggcggguacgaacuuucgccc

SEQ ID NO: 367 - RNA, 21 nt, Artificial Sequence
  Guide Sequence
gggcgaaaguucguacccgcc

SEQ ID NO: 368 - RNA, 21 nt, Artificial Sequence
  Guide Sequence
ggguacgaacuuucgcccuga

SEQ ID NO: 369 - RNA, 21 nt, Artificial Sequence
  Guide Sequence
gguacgaacuuucgcccugag

SEQ ID NO: 370 - RNA, 21 nt, Artificial Sequence
  Guide Sequence
guacccgccuagaggggaggg

SEQ ID NO: 371 - RNA, 21 nt, Artificial Sequence
  Guide Sequence
guacgaacuuucgcccugaga

SEQ ID NO: 372 - RNA, 21 nt, Artificial Sequence
  Guide Sequence
guucguacccgccuagagggg

SEQ ID NO: 373 - RNA, 21 nt, Artificial Sequence
  Guide Sequence
uacccgccuagaggggagggu

SEQ ID NO: 374 - RNA, 21 nt, Artificial Sequence
  Guide Sequence
uagacacccuccccucuaggc

SEQ ID NO: 375 - RNA, 21 nt, Artificial Sequence
  Guide Sequence
uaggcggguacgaacuuucgc

SEQ ID NO: 376 - RNA, 21 nt, Artificial Sequence
  Guide Sequence
ucagggcgaaaguucguaccc

SEQ ID NO: 377 - RNA, 21 nt, Artificial Sequence
  Guide Sequence
uccccucuaggcggguacgaa

SEQ ID NO: 378 - RNA, 21 nt, Artificial Sequence
  Guide Sequence
ucguacccgccuagaggggag

SEQ ID NO: 379 - RNA, 21 nt, Artificial Sequence
  Guide Sequence
ucuaggcggguacgaacuuuc

SEQ ID NO: 380 - RNA, 21 nt, Artificial Sequence
  Guide Sequence
ucucagggcgaaaguucguac

SEQ ID NO: 381 - RNA, 21 nt, Artificial Sequence
  Guide Sequence
ucucucagggcgaaaguucgu

SEQ ID NO: 382 - RNA, 21 nt, Artificial Sequence
  Guide Sequence
uucguacccgccuagagggga

SEQ ID NO: 383 - RNA, 22 nt, Artificial Sequence
  Guide Sequence
aaaguucguacccgccuagagg

SEQ ID NO: 384 - RNA, 22 nt, Artificial Sequence
  Guide Sequence
aaguucguacccgccuagaggg

SEQ ID NO: 385 - RNA, 22 nt, Artificial Sequence
  Guide Sequence
acacccuccccucuaggcgggu

SEQ ID NO: 386 - RNA, 22 nt, Artificial Sequence
  Guide Sequence
acccuccccucuaggcggguac

SEQ ID NO: 387 - RNA, 22 nt, Artificial Sequence
  Guide Sequence
agacacccuccccucuaggcgg

SEQ ID NO: 388 - RNA, 22 nt, Artificial Sequence
  Guide Sequence
aggcggguacgaacuuucgccc

SEQ ID NO: 389 - RNA, 22 nt, Artificial Sequence
  Guide Sequence
agggcgaaaguucguacccgcc

SEQ ID NO: 390 - RNA, 22 nt, Artificial Sequence
  Guide Sequence
aguucguacccgccuagagggg

SEQ ID NO: 391 - RNA, 22 nt, Artificial Sequence
  Guide Sequence
cacccuccccucuaggcgggua

SEQ ID NO: 392 - RNA, 22 nt, Artificial Sequence
  Guide Sequence
cagggcgaaaguucguacccgc

SEQ ID NO: 393 - RNA, 22 nt, Artificial Sequence
  Guide Sequence
ccccucuaggcggguacgaacu

SEQ ID NO: 394 - RNA, 22 nt, Artificial Sequence
  Guide Sequence
cccuccccucuaggcggguacg

SEQ ID NO: 395 - RNA, 22 nt, Artificial Sequence
  Guide Sequence
cccucuaggcggguacgaacuu

SEQ ID NO: 396 - RNA, 22 nt, Artificial Sequence
  Guide Sequence
ccuccccucuaggcggguacga

SEQ ID NO: 397 - RNA, 22 nt, Artificial Sequence
  Guide Sequence
ccucuaggcggguacgaacuuu

SEQ ID NO: 398 - RNA, 22 nt, Artificial Sequence
  Guide Sequence
ccucucucagggcgaaaguucg

SEQ ID NO: 399 - RNA, 22 nt, Artificial Sequence
  Guide Sequence
cgaaaguucguacccgccuaga

SEQ ID NO: 400 - RNA, 22 nt, Artificial Sequence
  Guide Sequence
cgccucucucagggcgaaaguu

SEQ ID NO: 401 - RNA, 22 nt, Artificial Sequence
  Guide Sequence
cggguacgaacuuucgcccuga

SEQ ID NO: 402 - RNA, 22 nt, Artificial Sequence
  Guide Sequence
cguacccgccuagaggggaggg

SEQ ID NO: 403 - RNA, 22 nt, Artificial Sequence
  Guide Sequence
cuagacacccuccccucuaggc

SEQ ID NO: 404 - RNA, 22 nt, Artificial Sequence
  Guide Sequence
cuaggcggguacgaacuuucgc

SEQ ID NO: 405 - RNA, 22 nt, Artificial Sequence
  Guide Sequence
cucagggcgaaaguucguaccc

SEQ ID NO: 406 - RNA, 22 nt, Artificial Sequence
  Guide Sequence
cuccccucuaggcggguacgaa

SEQ ID NO: 407 - RNA, 22 nt, Artificial Sequence
  Guide Sequence
cucuaggcggguacgaacuuuc

SEQ ID NO: 408 - RNA, 22 nt, Artificial Sequence
  Guide Sequence
cucucagggcgaaaguucguac

SEQ ID NO: 409 - RNA, 22 nt, Artificial Sequence
  Guide Sequence
cucucucagggcgaaaguucgu

SEQ ID NO: 410 - RNA, 22 nt, Artificial Sequence
  Guide Sequence
gaaaguucguacccgccuagag

SEQ ID NO: 411 - RNA, 22 nt, Artificial Sequence
  Guide Sequence
gacacccuccccucuaggcggg

SEQ ID NO: 412 - RNA, 22 nt, Artificial Sequence
  Guide Sequence
gccucucucagggcgaaaguuc

SEQ ID NO: 413 - RNA, 22 nt, Artificial Sequence
  Guide Sequence
gcgaaaguucguacccgccuag

SEQ ID NO: 414 - RNA, 22 nt, Artificial Sequence
  Guide Sequence
gcggguacgaacuuucgcccug

SEQ ID NO: 415 - RNA, 22 nt, Artificial Sequence
  Guide Sequence
ggcgaaaguucguacccgccua

SEQ ID NO: 416 - RNA, 22 nt, Artificial Sequence
  Guide Sequence
ggcggguacgaacuuucgcccu

SEQ ID NO: 417 - RNA, 22 nt, Artificial Sequence
  Guide Sequence
gggcgaaaguucguacccgccu

SEQ ID NO: 418 - RNA, 22 nt, Artificial Sequence
  Guide Sequence
ggguacgaacuuucgcccugag

SEQ ID NO: 419 - RNA, 22 nt, Artificial Sequence
  Guide Sequence
gguacgaacuuucgcccugaga

SEQ ID NO: 420 - RNA, 22 nt, Artificial Sequence
  Guide Sequence
guacccgccuagaggggagggu

SEQ ID NO: 421 - RNA, 22 nt, Artificial Sequence
  Guide Sequence
guacgaacuuucgcccugagag

SEQ ID NO: 422 - RNA, 22 nt, Artificial Sequence
  Guide Sequence
guucguacccgccuagagggga

SEQ ID NO: 423 - RNA, 22 nt, Artificial Sequence
  Guide Sequence
uacccgccuagaggggagggug

SEQ ID NO: 424 - RNA, 22 nt, Artificial Sequence
  Guide Sequence
uagacacccuccccucuaggcg

SEQ ID NO: 425 - RNA, 22 nt, Artificial Sequence
  Guide Sequence
uaggcggguacgaacuuucgcc

SEQ ID NO: 426 - RNA, 22 nt, Artificial Sequence
  Guide Sequence
ucagggcgaaaguucguacccg

SEQ ID NO: 427 - RNA, 22 nt, Artificial Sequence
  Guide Sequence
uccccucuaggcggguacgaac

SEQ ID NO: 428 - RNA, 22 nt, Artificial Sequence
  Guide Sequence
ucguacccgccuagaggggagg

SEQ ID NO: 429 - RNA, 22 nt, Artificial Sequence
  Guide Sequence
ucuaggcggguacgaacuuucg

SEQ ID NO: 430 - RNA, 22 nt, Artificial Sequence
  Guide Sequence
ucucagggcgaaaguucguacc

SEQ ID NO: 431 - RNA, 22 nt, Artificial Sequence
  Guide Sequence
ucucucagggcgaaaguucgua

SEQ ID NO: 432 - RNA, 22 nt, Artificial Sequence
  Guide Sequence
uucguacccgccuagaggggag

SEQ ID NO: 433 - RNA, 20 nt, Artificial Sequence
  Guide Sequence
aacuuucguccugagagagg

SEQ ID NO: 434 - RNA, 20 nt, Artificial Sequence
  Guide Sequence
acgaacuuucguccugagag

SEQ ID NO: 435 - RNA, 20 nt, Artificial Sequence
  Guide Sequence
acuuucguccugagagaggc

SEQ ID NO: 436 - RNA, 20 nt, Artificial Sequence
  Guide Sequence
aggacgaaaguucguccccg

SEQ ID NO: 437 - RNA, 20 nt, Artificial Sequence
  Guide Sequence
aggcggggacgaacuuucgu

SEQ ID NO: 438 - RNA, 20 nt, Artificial Sequence
  Guide Sequence
aggcuccgccucucucagga

SEQ ID NO: 439 - RNA, 20 nt, Artificial Sequence
  Guide Sequence
caggacgaaaguucgucccc

SEQ ID NO: 440 - RNA, 20 nt, Artificial Sequence
  Guide Sequence
ccgccucucucaggacgaaa

SEQ ID NO: 441 - RNA, 20 nt, Artificial Sequence
  Guide Sequence
ccucucucaggacgaaaguu

SEQ ID NO: 442 - RNA, 20 nt, Artificial Sequence
  Guide Sequence
cgaacuuucguccugagaga

SEQ ID NO: 443 - RNA, 20 nt, Artificial Sequence
  Guide Sequence
cgccucucucaggacgaaag

SEQ ID NO: 444 - RNA, 20 nt, Artificial Sequence
  Guide Sequence
cggggacgaacuuucguccu

SEQ ID NO: 445 - RNA, 20 nt, Artificial Sequence
  Guide Sequence
cguccugagagaggcggagc

SEQ ID NO: 446 - RNA, 20 nt, Artificial Sequence
  Guide Sequence
cuaggcggggacgaacuuuc

SEQ ID NO: 447 - RNA, 20 nt, Artificial Sequence
  Guide Sequence
cucaggacgaaaguucgucc

SEQ ID NO: 448 - RNA, 20 nt, Artificial Sequence
  Guide Sequence
cuccgccucucucaggacga

SEQ ID NO: 449 - RNA, 20 nt, Artificial Sequence
  Guide Sequence
cucuaggcggggacgaacuu

SEQ ID NO: 450 - RNA, 20 nt, Artificial Sequence
  Guide Sequence
cucucaggacgaaaguucgu

SEQ ID NO: 451 - RNA, 20 nt, Artificial Sequence
  Guide Sequence
cucucucaggacgaaaguuc

SEQ ID NO: 452 - RNA, 20 nt, Artificial Sequence
  Guide Sequence
cugaggcuccgccucucuca

SEQ ID NO: 453 - RNA, 20 nt, Artificial Sequence
  Guide Sequence
cuuucguccugagagaggcg

SEQ ID NO: 454 - RNA, 20 nt, Artificial Sequence
  Guide Sequence
gaacuuucguccugagagag

SEQ ID NO: 455 - RNA, 20 nt, Artificial Sequence
  Guide Sequence
gacgaaaguucguccccgcc

SEQ ID NO: 456 - RNA, 20 nt, Artificial Sequence
  Guide Sequence
gacgaacuuucguccugaga

SEQ ID NO: 457 - RNA, 20 nt, Artificial Sequence
  Guide Sequence
gaggcuccgccucucucagg

SEQ ID NO: 458 - RNA, 20 nt, Artificial Sequence
  Guide Sequence
gccucucucaggacgaaagu

SEQ ID NO: 459 - RNA, 20 nt, Artificial Sequence
  Guide Sequence
gcggggacgaacuuucgucc

SEQ ID NO: 460 - RNA, 20 nt, Artificial Sequence
  Guide Sequence
gcuccgccucucucaggacg

SEQ ID NO: 461 - RNA, 20 nt, Artificial Sequence
  Guide Sequence
gcugaggcuccgccucucuc

SEQ ID NO: 462 - RNA, 20 nt, Artificial Sequence
  Guide Sequence
ggacgaaaguucguccccgc

SEQ ID NO: 463 - RNA, 20 nt, Artificial Sequence
  Guide Sequence
ggacgaacuuucguccugag

SEQ ID NO: 464 - RNA, 20 nt, Artificial Sequence
  Guide Sequence
ggcggggacgaacuuucguc

SEQ ID NO: 465 - RNA, 20 nt, Artificial Sequence
  Guide Sequence
ggcuccgccucucucaggac

SEQ ID NO: 466 - RNA, 20 nt, Artificial Sequence
  Guide Sequence
gggacgaacuuucguccuga

SEQ ID NO: 467 - RNA, 20 nt, Artificial Sequence
  Guide Sequence
ggggacgaacuuucguccug

SEQ ID NO: 468 - RNA, 20 nt, Artificial Sequence
  Guide Sequence
guccugagagaggcggagcc

SEQ ID NO: 469 - RNA, 20 nt, Artificial Sequence
  Guide Sequence
uaggcggggacgaacuuucg

SEQ ID NO: 470 - RNA, 20 nt, Artificial Sequence
  Guide Sequence
ucaggacgaaaguucguccc

SEQ ID NO: 471 - RNA, 20 nt, Artificial Sequence
  Guide Sequence
uccgccucucucaggacgaa

SEQ ID NO: 472 - RNA, 20 nt, Artificial Sequence
  Guide Sequence
ucguccugagagaggcggag

SEQ ID NO: 473 - RNA, 20 nt, Artificial Sequence
  Guide Sequence
ucuaggcggggacgaacuuu

SEQ ID NO: 474 - RNA, 20 nt, Artificial Sequence
  Guide Sequence
ucucaggacgaaaguucguc

SEQ ID NO: 475 - RNA, 20 nt, Artificial Sequence
  Guide Sequence
ucucucaggacgaaaguucg

SEQ ID NO: 476 - RNA, 20 nt, Artificial Sequence
  Guide Sequence
ugaggcuccgccucucucag

SEQ ID NO: 477 - RNA, 20 nt, Artificial Sequence
  Guide Sequence
uucguccugagagaggcgga

SEQ ID NO: 478 - RNA, 20 nt, Artificial Sequence
  Guide Sequence
uuucguccugagagaggcgg

SEQ ID NO: 479 - RNA, 21 nt, Artificial Sequence
  Guide Sequence
aacuuucguccugagagaggc

SEQ ID NO: 480 - RNA, 21 nt, Artificial Sequence
  Guide Sequence
acgaacuuucguccugagaga

SEQ ID NO: 481 - RNA, 21 nt, Artificial Sequence
  Guide Sequence
acuuucguccugagagaggcg

SEQ ID NO: 482 - RNA, 21 nt, Artificial Sequence
  Guide Sequence
aggacgaaaguucguccccgc

SEQ ID NO: 483 - RNA, 21 nt, Artificial Sequence
  Guide Sequence
aggcggggacgaacuuucguc

SEQ ID NO: 484 - RNA, 21 nt, Artificial Sequence
  Guide Sequence
aggcuccgccucucucaggac

SEQ ID NO: 485 - RNA, 21 nt, Artificial Sequence
  Guide Sequence
caggacgaaaguucguccccg

SEQ ID NO: 486 - RNA, 21 nt, Artificial Sequence
  Guide Sequence
ccgccucucucaggacgaaag

SEQ ID NO: 487 - RNA, 21 nt, Artificial Sequence
  Guide Sequence
ccucuaggcggggacgaacuu

SEQ ID NO: 488 - RNA, 21 nt, Artificial Sequence
  Guide Sequence
ccucucucaggacgaaaguuc

SEQ ID NO: 489 - RNA, 21 nt, Artificial Sequence
  Guide Sequence
cgaacuuucguccugagagag

SEQ ID NO: 490 - RNA, 21 nt, Artificial Sequence
  Guide Sequence
cgccucucucaggacgaaagu

SEQ ID NO: 491 - RNA, 21 nt, Artificial Sequence
  Guide Sequence
cgcugaggcuccgccucucuc

SEQ ID NO: 492 - RNA, 21 nt, Artificial Sequence
  Guide Sequence
cggggacgaacuuucguccug

SEQ ID NO: 493 - RNA, 21 nt, Artificial Sequence
  Guide Sequence
cguccugagagaggcggagcc

SEQ ID NO: 494 - RNA, 21 nt, Artificial Sequence
  Guide Sequence
cuaggcggggacgaacuuucg

SEQ ID NO: 495 - RNA, 21 nt, Artificial Sequence
  Guide Sequence
cucaggacgaaaguucguccc

SEQ ID NO: 496 - RNA, 21 nt, Artificial Sequence
  Guide Sequence
cuccgccucucucaggacgaa

SEQ ID NO: 497 - RNA, 21 nt, Artificial Sequence
  Guide Sequence
cucuaggcggggacgaacuuu

SEQ ID NO: 498 - RNA, 21 nt, Artificial Sequence
  Guide Sequence
cucucaggacgaaaguucguc

SEQ ID NO: 499 - RNA, 21 nt, Artificial Sequence
  Guide Sequence
cucucucaggacgaaaguucg

SEQ ID NO: 500 - RNA, 21 nt, Artificial Sequence
  Guide Sequence
cugaggcuccgccucucucag

SEQ ID NO: 501 - RNA, 21 nt, Artificial Sequence
  Guide Sequence
cuuucguccugagagaggcgg

SEQ ID NO: 502 - RNA, 21 nt, Artificial Sequence
  Guide Sequence
gaacuuucguccugagagagg

SEQ ID NO: 503 - RNA, 21 nt, Artificial Sequence
  Guide Sequence
gacgaaaguucguccccgccu

SEQ ID NO: 504 - RNA, 21 nt, Artificial Sequence
  Guide Sequence
gacgaacuuucguccugagag

SEQ ID NO: 505 - RNA, 21 nt, Artificial Sequence
  Guide Sequence
gaggcuccgccucucucagga

SEQ ID NO: 506 - RNA, 21 nt, Artificial Sequence
  Guide Sequence
gccucucucaggacgaaaguu

SEQ ID NO: 507 - RNA, 21 nt, Artificial Sequence
  Guide Sequence
gcggggacgaacuuucguccu

SEQ ID NO: 508 - RNA, 21 nt, Artificial Sequence
  Guide Sequence
gcuccgccucucucaggacga

SEQ ID NO: 509 - RNA, 21 nt, Artificial Sequence
  Guide Sequence
gcugaggcuccgccucucuca

SEQ ID NO: 510 - RNA, 21 nt, Artificial Sequence
  Guide Sequence
ggacgaaaguucguccccgcc

SEQ ID NO: 511 - RNA, 21 nt, Artificial Sequence
  Guide Sequence
ggacgaacuuucguccugaga

SEQ ID NO: 512 - RNA, 21 nt, Artificial Sequence
  Guide Sequence
ggcggggacgaacuuucgucc

SEQ ID NO: 513 - RNA, 21 nt, Artificial Sequence
  Guide Sequence
ggcuccgccucucucaggacg

SEQ ID NO: 514 - RNA, 21 nt, Artificial Sequence
  Guide Sequence
gggacgaacuuucguccugag

SEQ ID NO: 515 - RNA, 21 nt, Artificial Sequence
  Guide Sequence
ggggacgaacuuucguccuga

SEQ ID NO: 516 - RNA, 21 nt, Artificial Sequence
  Guide Sequence
guccugagagaggcggagccu

SEQ ID NO: 517 - RNA, 21 nt, Artificial Sequence
  Guide Sequence
uaggcggggacgaacuuucgu

SEQ ID NO: 518 - RNA, 21 nt, Artificial Sequence
  Guide Sequence
ucaggacgaaaguucgucccc

SEQ ID NO: 519 - RNA, 21 nt, Artificial Sequence
  Guide Sequence
uccgccucucucaggacgaaa

SEQ ID NO: 520 - RNA, 21 nt, Artificial Sequence
  Guide Sequence
ucguccugagagaggcggagc

SEQ ID NO: 521 - RNA, 21 nt, Artificial Sequence
  Guide Sequence
ucuaggcggggacgaacuuuc

SEQ ID NO: 522 - RNA, 21 nt, Artificial Sequence
  Guide Sequence
ucucaggacgaaaguucgucc

SEQ ID NO: 523 - RNA, 21 nt, Artificial Sequence
  Guide Sequence
ucucucaggacgaaaguucgu

SEQ ID NO: 524 - RNA, 21 nt, Artificial Sequence
  Guide Sequence
ugaggcuccgccucucucagg

SEQ ID NO: 525 - RNA, 21 nt, Artificial Sequence
  Guide Sequence
uucguccugagagaggcggag

SEQ ID NO: 526 - RNA, 21 nt, Artificial Sequence
  Guide Sequence
uuucguccugagagaggcgga

SEQ ID NO: 527 - RNA, 22 nt, Artificial Sequence
  Guide Sequence
aacuuucguccugagagaggcg

SEQ ID NO: 528 - RNA, 22 nt, Artificial Sequence
  Guide Sequence
acgaacuuucguccugagagag

SEQ ID NO: 529 - RNA, 22 nt, Artificial Sequence
  Guide Sequence
acgcugaggcuccgccucucuc

SEQ ID NO: 530 - RNA, 22 nt, Artificial Sequence
  Guide Sequence
acuuucguccugagagaggcgg

SEQ ID NO: 531 - RNA, 22 nt, Artificial Sequence
  Guide Sequence
aggacgaaaguucguccccgcc

SEQ ID NO: 532 - RNA, 22 nt, Artificial Sequence
  Guide Sequence
aggcggggacgaacuuucgucc

SEQ ID NO: 533 - RNA, 22 nt, Artificial Sequence
  Guide Sequence
aggcuccgccucucucaggacg

SEQ ID NO: 534 - RNA, 22 nt, Artificial Sequence
  Guide Sequence
caggacgaaaguucguccccgc

SEQ ID NO: 535 - RNA, 22 nt, Artificial Sequence
  Guide Sequence
cccucuaggcggggacgaacuu

SEQ ID NO: 536 - RNA, 22 nt, Artificial Sequence
  Guide Sequence
ccgccucucucaggacgaaagu

SEQ ID NO: 537 - RNA, 22 nt, Artificial Sequence
  Guide Sequence
ccucuaggcggggacgaacuuu

SEQ ID NO: 538 - RNA, 22 nt, Artificial Sequence
  Guide Sequence
ccucucucaggacgaaaguucg

SEQ ID NO: 539 - RNA, 22 nt, Artificial Sequence
  Guide Sequence
cgaacuuucguccugagagagg

SEQ ID NO: 540 - RNA, 22 nt, Artificial Sequence
  Guide Sequence
cgccucucucaggacgaaaguu

SEQ ID NO: 541 - RNA, 22 nt, Artificial Sequence
  Guide Sequence
cgcugaggcuccgccucucuca

SEQ ID NO: 542 - RNA, 22 nt, Artificial Sequence
  Guide Sequence
cggggacgaacuuucguccuga

SEQ ID NO: 543 - RNA, 22 nt, Artificial Sequence
  Guide Sequence
cguccugagagaggcggagccu

SEQ ID NO: 544 - RNA, 22 nt, Artificial Sequence
  Guide Sequence
cuaggcggggacgaacuuucgu

SEQ ID NO: 545 - RNA, 22 nt, Artificial Sequence
  Guide Sequence
cucaggacgaaaguucgucccc

SEQ ID NO: 546 - RNA, 22 nt, Artificial Sequence
  Guide Sequence
cuccgccucucucaggacgaaa

SEQ ID NO: 547 - RNA, 22 nt, Artificial Sequence
  Guide Sequence
cucuaggcggggacgaacuuuc

SEQ ID NO: 548 - RNA, 22 nt, Artificial Sequence
  Guide Sequence
cucucaggacgaaaguucgucc

SEQ ID NO: 549 - RNA, 22 nt, Artificial Sequence
  Guide Sequence
cucucucaggacgaaaguucgu

SEQ ID NO: 550 - RNA, 22 nt, Artificial Sequence
  Guide Sequence
cugaggcuccgccucucucagg

SEQ ID NO: 551 - RNA, 22 nt, Artificial Sequence
  Guide Sequence
cuuucguccugagagaggcgga

SEQ ID NO: 552 - RNA, 22 nt, Artificial Sequence
  Guide Sequence
gaacuuucguccugagagaggc

SEQ ID NO: 553 - RNA, 22 nt, Artificial Sequence
  Guide Sequence
gacgaaaguucguccccgccua

SEQ ID NO: 554 - RNA, 22 nt, Artificial Sequence
  Guide Sequence
gacgaacuuucguccugagaga

SEQ ID NO: 555 - RNA, 22 nt, Artificial Sequence
  Guide Sequence
gaggcuccgccucucucaggac

SEQ ID NO: 556 - RNA, 22 nt, Artificial Sequence
  Guide Sequence
gccucucucaggacgaaaguuc

SEQ ID NO: 557 - RNA, 22 nt, Artificial Sequence
  Guide Sequence
gcggggacgaacuuucguccug

SEQ ID NO: 558 - RNA, 22 nt, Artificial Sequence
  Guide Sequence
gcuccgccucucucaggacgaa

SEQ ID NO: 559 - RNA, 22 nt, Artificial Sequence
  Guide Sequence
gcugaggcuccgccucucucag

SEQ ID NO: 560 - RNA, 22 nt, Artificial Sequence
  Guide Sequence
ggacgaaaguucguccccgccu

SEQ ID NO: 561 - RNA, 22 nt, Artificial Sequence
  Guide Sequence
ggacgaacuuucguccugagag

SEQ ID NO: 562 - RNA, 22 nt, Artificial Sequence
  Guide Sequence
ggcggggacgaacuuucguccu

SEQ ID NO: 563 - RNA, 22 nt, Artificial Sequence
  Guide Sequence
ggcuccgccucucucaggacga

SEQ ID NO: 564 - RNA, 22 nt, Artificial Sequence
  Guide Sequence
gggacgaacuuucguccugaga

SEQ ID NO: 565 - RNA, 22 nt, Artificial Sequence
  Guide Sequence
ggggacgaacuuucguccugag

SEQ ID NO: 566 - RNA, 22 nt, Artificial Sequence
  Guide Sequence
guccugagagaggcggagccuc

SEQ ID NO: 567 - RNA, 22 nt, Artificial Sequence
  Guide Sequence
uaggcggggacgaacuuucguc

SEQ ID NO: 568 - RNA, 22 nt, Artificial Sequence
  Guide Sequence
ucaggacgaaaguucguccccg

SEQ ID NO: 569 - RNA, 22 nt, Artificial Sequence
  Guide Sequence
uccgccucucucaggacgaaag

SEQ ID NO: 570 - RNA, 22 nt, Artificial Sequence
  Guide Sequence
ucguccugagagaggcggagcc

SEQ ID NO: 571 - RNA, 22 nt, Artificial Sequence
  Guide Sequence
ucuaggcggggacgaacuuucg

SEQ ID NO: 572 - RNA, 22 nt, Artificial Sequence
  Guide Sequence
ucucaggacgaaaguucguccc

SEQ ID NO: 573 - RNA, 22 nt, Artificial Sequence
  Guide Sequence
ucucucaggacgaaaguucguc

SEQ ID NO: 574 - RNA, 22 nt, Artificial Sequence
  Guide Sequence
ugaggcuccgccucucucagga

SEQ ID NO: 575 - RNA, 22 nt, Artificial Sequence
  Guide Sequence
uucguccugagagaggcggagc

SEQ ID NO: 576 - RNA, 22 nt, Artificial Sequence
  Guide Sequence
uuucguccugagagaggcggag

SEQ ID NO: 577 - RNA, 20 nt, Artificial Sequence
  Guide Sequence
aacucucgcgagauccuacg

SEQ ID NO: 578 - RNA, 20 nt, Artificial Sequence
  Guide Sequence
aagucgggcguaggaucucg

SEQ ID NO: 579 - RNA, 20 nt, Artificial Sequence
  Guide Sequence
acaagucgggcguaggaucu

SEQ ID NO: 580 - RNA, 20 nt, Artificial Sequence
  Guide Sequence
acucucgcgagauccuacgc

SEQ ID NO: 581 - RNA, 20 nt, Artificial Sequence
  Guide Sequence
agauccuacgcccgacuugu

SEQ ID NO: 582 - RNA, 20 nt, Artificial Sequence
  Guide Sequence
agcuuucggaacucucgcga

SEQ ID NO: 583 - RNA, 20 nt, Artificial Sequence
  Guide Sequence
aggaucucgcgagaguuccg

SEQ ID NO: 584 - RNA, 20 nt, Artificial Sequence
  Guide Sequence
agucgggcguaggaucucgc

SEQ ID NO: 585 - RNA, 20 nt, Artificial Sequence
  Guide Sequence
auccuacgcccgacuugugc

SEQ ID NO: 586 - RNA, 20 nt, Artificial Sequence
  Guide Sequence
caagucgggcguaggaucuc

SEQ ID NO: 587 - RNA, 20 nt, Artificial Sequence
  Guide Sequence
cacaagucgggcguaggauc

SEQ ID NO: 588 - RNA, 20 nt, Artificial Sequence
  Guide Sequence
cgagauccuacgcccgacuu

SEQ ID NO: 589 - RNA, 20 nt, Artificial Sequence
  Guide Sequence
cgcacaagucgggcguagga

SEQ ID NO: 590 - RNA, 20 nt, Artificial Sequence
  Guide Sequence
cgcgagauccuacgcccgac

SEQ ID NO: 591 - RNA, 20 nt, Artificial Sequence
  Guide Sequence
cggaacucucgcgagauccu

SEQ ID NO: 592 - RNA, 20 nt, Artificial Sequence
  Guide Sequence
cgggcgcacaagucgggcgu

SEQ ID NO: 593 - RNA, 20 nt, Artificial Sequence
  Guide Sequence
cgggcguaggaucucgcgag

SEQ ID NO: 594 - RNA, 20 nt, Artificial Sequence
  Guide Sequence
cguaggaucucgcgagaguu

SEQ ID NO: 595 - RNA, 20 nt, Artificial Sequence
  Guide Sequence
cucgcgagauccuacgcccg

SEQ ID NO: 596 - RNA, 20 nt, Artificial Sequence
  Guide Sequence
cucucgcgagauccuacgcc

SEQ ID NO: 597 - RNA, 20 nt, Artificial Sequence
  Guide Sequence
cuuucggaacucucgcgaga

SEQ ID NO: 598 - RNA, 20 nt, Artificial Sequence
  Guide Sequence
gaacucucgcgagauccuac

SEQ ID NO: 599 - RNA, 20 nt, Artificial Sequence
  Guide Sequence
gagauccuacgcccgacuug

SEQ ID NO: 600 - RNA, 20 nt, Artificial Sequence
  Guide Sequence
gagcuuucggaacucucgcg

SEQ ID NO: 601 - RNA, 20 nt, Artificial Sequence
  Guide Sequence
gauccuacgcccgacuugug

SEQ ID NO: 602 - RNA, 20 nt, Artificial Sequence
  Guide Sequence
gaucucgcgagaguuccgaa

SEQ ID NO: 603 - RNA, 20 nt, Artificial Sequence
  Guide Sequence
gcacaagucgggcguaggau

SEQ ID NO: 604 - RNA, 20 nt, Artificial Sequence
  Guide Sequence
gcgagauccuacgcccgacu

SEQ ID NO: 605 - RNA, 20 nt, Artificial Sequence
  Guide Sequence
gcgcacaagucgggcguagg

SEQ ID NO: 606 - RNA, 20 nt, Artificial Sequence
  Guide Sequence
gcguaggaucucgcgagagu

SEQ ID NO: 607 - RNA, 20 nt, Artificial Sequence
  Guide Sequence
gcuuucggaacucucgcgag

SEQ ID NO: 608 - RNA, 20 nt, Artificial Sequence
  Guide Sequence
ggaacucucgcgagauccua

SEQ ID NO: 609 - RNA, 20 nt, Artificial Sequence
  Guide Sequence
ggaucucgcgagaguuccga

SEQ ID NO: 610 - RNA, 20 nt, Artificial Sequence
  Guide Sequence
ggcgcacaagucgggcguag

SEQ ID NO: 611 - RNA, 20 nt, Artificial Sequence
  Guide Sequence
ggcguaggaucucgcgagag

SEQ ID NO: 612 - RNA, 20 nt, Artificial Sequence
  Guide Sequence
gggcgcacaagucgggcgua

SEQ ID NO: 613 - RNA, 20 nt, Artificial Sequence
  Guide Sequence
gggcguaggaucucgcgaga

SEQ ID NO: 614 - RNA, 20 nt, Artificial Sequence
  Guide Sequence
guaggaucucgcgagaguuc

SEQ ID NO: 615 - RNA, 20 nt, Artificial Sequence
  Guide Sequence
gucgggcguaggaucucgcg

SEQ ID NO: 616 - RNA, 20 nt, Artificial Sequence
  Guide Sequence
uaggaucucgcgagaguucc

SEQ ID NO: 617 - RNA, 20 nt, Artificial Sequence
  Guide Sequence
ucgcgagauccuacgcccga

SEQ ID NO: 618 - RNA, 20 nt, Artificial Sequence
  Guide Sequence
ucggaacucucgcgagaucc

SEQ ID NO: 619 - RNA, 20 nt, Artificial Sequence
  Guide Sequence
ucgggcguaggaucucgcga

SEQ ID NO: 620 - RNA, 20 nt, Artificial Sequence
  Guide Sequence
ucucgcgagauccuacgccc

SEQ ID NO: 621 - RNA, 20 nt, Artificial Sequence
  Guide Sequence
uucggaacucucgcgagauc

SEQ ID NO: 622 - RNA, 20 nt, Artificial Sequence
  Guide Sequence
uuucggaacucucgcgagau

SEQ ID NO: 623 - RNA, 21 nt, Artificial Sequence
  Guide Sequence
aacucucgcgagauccuacgc

SEQ ID NO: 624 - RNA, 21 nt, Artificial Sequence
  Guide Sequence
aagucgggcguaggaucucgc

SEQ ID NO: 625 - RNA, 21 nt, Artificial Sequence
  Guide Sequence
acaagucgggcguaggaucuc

SEQ ID NO: 626 - RNA, 21 nt, Artificial Sequence
  Guide Sequence
acucucgcgagauccuacgcc

SEQ ID NO: 627 - RNA, 21 nt, Artificial Sequence
  Guide Sequence
agauccuacgcccgacuugug

SEQ ID NO: 628 - RNA, 21 nt, Artificial Sequence
  Guide Sequence
agcuuucggaacucucgcgag

SEQ ID NO: 629 - RNA, 21 nt, Artificial Sequence
  Guide Sequence
aggaucucgcgagaguuccga

SEQ ID NO: 630 - RNA, 21 nt, Artificial Sequence
  Guide Sequence
agucgggcguaggaucucgcg

SEQ ID NO: 631 - RNA, 21 nt, Artificial Sequence
  Guide Sequence
auccuacgcccgacuugugcg

SEQ ID NO: 632 - RNA, 21 nt, Artificial Sequence
  Guide Sequence
caagucgggcguaggaucucg

SEQ ID NO: 633 - RNA, 21 nt, Artificial Sequence
  Guide Sequence
cacaagucgggcguaggaucu

SEQ ID NO: 634 - RNA, 21 nt, Artificial Sequence
  Guide Sequence
ccgggcgcacaagucgggcgu

SEQ ID NO: 635 - RNA, 21 nt, Artificial Sequence
  Guide Sequence
cgagauccuacgcccgacuug

SEQ ID NO: 636 - RNA, 21 nt, Artificial Sequence
  Guide Sequence
cgagcuuucggaacucucgcg

SEQ ID NO: 637 - RNA, 21 nt, Artificial Sequence
  Guide Sequence
cgcacaagucgggcguaggau

SEQ ID NO: 638 - RNA, 21 nt, Artificial Sequence
  Guide Sequence
cgcgagauccuacgcccgacu

SEQ ID NO: 639 - RNA, 21 nt, Artificial Sequence
  Guide Sequence
cggaacucucgcgagauccua

SEQ ID NO: 640 - RNA, 21 nt, Artificial Sequence
  Guide Sequence
cgggcgcacaagucgggcgua

SEQ ID NO: 641 - RNA, 21 nt, Artificial Sequence
  Guide Sequence
cgggcguaggaucucgcgaga

SEQ ID NO: 642 - RNA, 21 nt, Artificial Sequence
  Guide Sequence
cguaggaucucgcgagaguuc

SEQ ID NO: 643 - RNA, 21 nt, Artificial Sequence
  Guide Sequence
cucgcgagauccuacgcccga

SEQ ID NO: 644 - RNA, 21 nt, Artificial Sequence
  Guide Sequence
cucucgcgagauccuacgccc

SEQ ID NO: 645 - RNA, 21 nt, Artificial Sequence
  Guide Sequence
cuuucggaacucucgcgagau

SEQ ID NO: 646 - RNA, 21 nt, Artificial Sequence
  Guide Sequence
gaacucucgcgagauccuacg

SEQ ID NO: 647 - RNA, 21 nt, Artificial Sequence
  Guide Sequence
gagauccuacgcccgacuugu

SEQ ID NO: 648 - RNA, 21 nt, Artificial Sequence
  Guide Sequence
gagcuuucggaacucucgcga

SEQ ID NO: 649 - RNA, 21 nt, Artificial Sequence
  Guide Sequence
gauccuacgcccgacuugugc

SEQ ID NO: 650 - RNA, 21 nt, Artificial Sequence
  Guide Sequence
gaucucgcgagaguuccgaaa

SEQ ID NO: 651 - RNA, 21 nt, Artificial Sequence
  Guide Sequence
gcacaagucgggcguaggauc

SEQ ID NO: 652 - RNA, 21 nt, Artificial Sequence
  Guide Sequence
gcgagauccuacgcccgacuu

SEQ ID NO: 653 - RNA, 21 nt, Artificial Sequence
  Guide Sequence
gcgcacaagucgggcguagga

SEQ ID NO: 654 - RNA, 21 nt, Artificial Sequence
  Guide Sequence
gcguaggaucucgcgagaguu

SEQ ID NO: 655 - RNA, 21 nt, Artificial Sequence
  Guide Sequence
gcuuucggaacucucgcgaga

SEQ ID NO: 656 - RNA, 21 nt, Artificial Sequence
  Guide Sequence
ggaacucucgcgagauccuac

SEQ ID NO: 657 - RNA, 21 nt, Artificial Sequence
  Guide Sequence
ggaucucgcgagaguuccgaa

SEQ ID NO: 658 - RNA, 21 nt, Artificial Sequence
  Guide Sequence
ggcgcacaagucgggcguagg

SEQ ID NO: 659 - RNA, 21 nt, Artificial Sequence
  Guide Sequence
ggcguaggaucucgcgagagu

SEQ ID NO: 660 - RNA, 21 nt, Artificial Sequence
  Guide Sequence
gggcgcacaagucgggcguag

SEQ ID NO: 661 - RNA, 21 nt, Artificial Sequence
  Guide Sequence
gggcguaggaucucgcgagag

SEQ ID NO: 662 - RNA, 21 nt, Artificial Sequence
  Guide Sequence
guaggaucucgcgagaguucc

SEQ ID NO: 663 - RNA, 21 nt, Artificial Sequence
  Guide Sequence
gucgggcguaggaucucgcga

SEQ ID NO: 664 - RNA, 21 nt, Artificial Sequence
  Guide Sequence
uaggaucucgcgagaguuccg

SEQ ID NO: 665 - RNA, 21 nt, Artificial Sequence
  Guide Sequence
ucgcgagauccuacgcccgac

SEQ ID NO: 666 - RNA, 21 nt, Artificial Sequence
  Guide Sequence
ucggaacucucgcgagauccu

SEQ ID NO: 667 - RNA, 21 nt, Artificial Sequence
  Guide Sequence
ucgggcguaggaucucgcgag

SEQ ID NO: 668 - RNA, 21 nt, Artificial Sequence
  Guide Sequence
ucucgcgagauccuacgcccg

SEQ ID NO: 669 - RNA, 21 nt, Artificial Sequence
  Guide Sequence
uucggaacucucgcgagaucc

SEQ ID NO: 670 - RNA, 21 nt, Artificial Sequence
  Guide Sequence
uuucggaacucucgcgagauc

SEQ ID NO: 671 - RNA, 22 nt, Artificial Sequence
  Guide Sequence
aacucucgcgagauccuacgcc

SEQ ID NO: 672 - RNA, 22 nt, Artificial Sequence
  Guide Sequence
aagucgggcguaggaucucgcg

SEQ ID NO: 673 - RNA, 22 nt, Artificial Sequence
  Guide Sequence
acaagucgggcguaggaucucg

SEQ ID NO: 674 - RNA, 22 nt, Artificial Sequence
  Guide Sequence
acucucgcgagauccuacgccc

SEQ ID NO: 675 - RNA, 22 nt, Artificial Sequence
  Guide Sequence
agauccuacgcccgacuugugc

SEQ ID NO: 676 - RNA, 22 nt, Artificial Sequence
  Guide Sequence
agcuuucggaacucucgcgaga

SEQ ID NO: 677 - RNA, 22 nt, Artificial Sequence
  Guide Sequence
aggaucucgcgagaguuccgaa

SEQ ID NO: 678 - RNA, 22 nt, Artificial Sequence
  Guide Sequence
agucgggcguaggaucucgcga

SEQ ID NO: 679 - RNA, 22 nt, Artificial Sequence
  Guide Sequence
auccuacgcccgacuugugcgc

SEQ ID NO: 680 - RNA, 22 nt, Artificial Sequence
  Guide Sequence
caagucgggcguaggaucucgc

SEQ ID NO: 681 - RNA, 22 nt, Artificial Sequence
  Guide Sequence
cacaagucgggcguaggaucuc

SEQ ID NO: 682 - RNA, 22 nt, Artificial Sequence
  Guide Sequence
cccgggcgcacaagucgggcgu

SEQ ID NO: 683 - RNA, 22 nt, Artificial Sequence
  Guide Sequence
ccgggcgcacaagucgggcgua

SEQ ID NO: 684 - RNA, 22 nt, Artificial Sequence
  Guide Sequence
cgagauccuacgcccgacuugu

SEQ ID NO: 685 - RNA, 22 nt, Artificial Sequence
  Guide Sequence
cgagcuuucggaacucucgcga

SEQ ID NO: 686 - RNA, 22 nt, Artificial Sequence
  Guide Sequence
cgcacaagucgggcguaggauc

SEQ ID NO: 687 - RNA, 22 nt, Artificial Sequence
  Guide Sequence
cgcgagauccuacgcccgacuu

SEQ ID NO: 688 - RNA, 22 nt, Artificial Sequence
  Guide Sequence
cggaacucucgcgagauccuac

SEQ ID NO: 689 - RNA, 22 nt, Artificial Sequence
  Guide Sequence
cgggcgcacaagucgggcguag

SEQ ID NO: 690 - RNA, 22 nt, Artificial Sequence
  Guide Sequence
cgggcguaggaucucgcgagag

SEQ ID NO: 691 - RNA, 22 nt, Artificial Sequence
  Guide Sequence
cguaggaucucgcgagaguucc

SEQ ID NO: 692 - RNA, 22 nt, Artificial Sequence
  Guide Sequence
cucgcgagauccuacgcccgac

SEQ ID NO: 693 - RNA, 22 nt, Artificial Sequence
  Guide Sequence
cucucgcgagauccuacgcccg

SEQ ID NO: 694 - RNA, 22 nt, Artificial Sequence
  Guide Sequence
cuuucggaacucucgcgagauc

SEQ ID NO: 695 - RNA, 22 nt, Artificial Sequence
  Guide Sequence
gaacucucgcgagauccuacgc

SEQ ID NO: 696 - RNA, 22 nt, Artificial Sequence
  Guide Sequence
gagauccuacgcccgacuugug

SEQ ID NO: 697 - RNA, 22 nt, Artificial Sequence
  Guide Sequence
gagcuuucggaacucucgcgag

SEQ ID NO: 698 - RNA, 22 nt, Artificial Sequence
  Guide Sequence
gauccuacgcccgacuugugcg

SEQ ID NO: 699 - RNA, 22 nt, Artificial Sequence
  Guide Sequence
gaucucgcgagaguuccgaaag

SEQ ID NO: 700 - RNA, 22 nt, Artificial Sequence
  Guide Sequence
gcacaagucgggcguaggaucu

SEQ ID NO: 701 - RNA, 22 nt, Artificial Sequence
  Guide Sequence
gcgagauccuacgcccgacuug

SEQ ID NO: 702 - RNA, 22 nt, Artificial Sequence
  Guide Sequence
gcgagcuuucggaacucucgcg

SEQ ID NO: 703 - RNA, 22 nt, Artificial Sequence
  Guide Sequence
gcgcacaagucgggcguaggau

SEQ ID NO: 704 - RNA, 22 nt, Artificial Sequence
  Guide Sequence
gcguaggaucucgcgagaguuc

SEQ ID NO: 705 - RNA, 22 nt, Artificial Sequence
  Guide Sequence
gcuuucggaacucucgcgagau

SEQ ID NO: 706 - RNA, 22 nt, Artificial Sequence
  Guide Sequence
ggaacucucgcgagauccuacg

SEQ ID NO: 707 - RNA, 22 nt, Artificial Sequence
  Guide Sequence
ggaucucgcgagaguuccgaaa

SEQ ID NO: 708 - RNA, 22 nt, Artificial Sequence
  Guide Sequence
ggcgcacaagucgggcguagga

SEQ ID NO: 709 - RNA, 22 nt, Artificial Sequence
  Guide Sequence
ggcguaggaucucgcgagaguu

SEQ ID NO: 710 - RNA, 22 nt, Artificial Sequence
  Guide Sequence
gggcgcacaagucgggcguagg

SEQ ID NO: 711 - RNA, 22 nt, Artificial Sequence
  Guide Sequence
gggcguaggaucucgcgagagu

SEQ ID NO: 712 - RNA, 22 nt, Artificial Sequence
  Guide Sequence
guaggaucucgcgagaguuccg

SEQ ID NO: 713 - RNA, 22 nt, Artificial Sequence
  Guide Sequence
gucgggcguaggaucucgcgag

SEQ ID NO: 714 - RNA, 22 nt, Artificial Sequence
  Guide Sequence
uaggaucucgcgagaguuccga

SEQ ID NO: 715 - RNA, 22 nt, Artificial Sequence
  Guide Sequence
ucgcgagauccuacgcccgacu

SEQ ID NO: 716 - RNA, 22 nt, Artificial Sequence
  Guide Sequence
ucggaacucucgcgagauccua

SEQ ID NO: 717 - RNA, 22 nt, Artificial Sequence
  Guide Sequence
ucgggcguaggaucucgcgaga

SEQ ID NO: 718 - RNA, 22 nt, Artificial Sequence
  Guide Sequence
ucucgcgagauccuacgcccga

SEQ ID NO: 719 - RNA, 22 nt, Artificial Sequence
  Guide Sequence
uucggaacucucgcgagauccu

SEQ ID NO: 720 - RNA, 22 nt, Artificial Sequence
  Guide Sequence
uuucggaacucucgcgagaucc

SEQ ID NO: 721 - RNA, 20 nt, Artificial Sequence
  Guide Sequence
agcccccgcuuaccgugcgg

SEQ ID NO: 722 - RNA, 20 nt, Artificial Sequence
  Guide Sequence
agcgcgggggccgcacggua

SEQ ID NO: 723 - RNA, 20 nt, Artificial Sequence
  Guide Sequence
cccccgcuuaccgugcggcc

SEQ ID NO: 724 - RNA, 20 nt, Artificial Sequence
  Guide Sequence
ccccgcuuaccgugcggccc

SEQ ID NO: 725 - RNA, 20 nt, Artificial Sequence
  Guide Sequence
cccgcuuaccgugcggcccc

SEQ ID NO: 726 - RNA, 20 nt, Artificial Sequence
  Guide Sequence
ccgcuuaccgugcggccccc

SEQ ID NO: 727 - RNA, 20 nt, Artificial Sequence
  Guide Sequence
cgcgggggccgcacgguaag

SEQ ID NO: 728 - RNA, 20 nt, Artificial Sequence
  Guide Sequence
cgcuuaccgugcggcccccg

SEQ ID NO: 729 - RNA, 20 nt, Artificial Sequence
  Guide Sequence
cgggggccgcacgguaagcg

SEQ ID NO: 730 - RNA, 20 nt, Artificial Sequence
  Guide Sequence
cuuaccgugcggcccccgcg

SEQ ID NO: 731 - RNA, 20 nt, Artificial Sequence
  Guide Sequence
cuuuccccuggcuggcagcg

SEQ ID NO: 732 - RNA, 20 nt, Artificial Sequence
  Guide Sequence
gagcccccgcuuaccgugcg

SEQ ID NO: 733 - RNA, 20 nt, Artificial Sequence
  Guide Sequence
gcccccgcuuaccgugcggc

SEQ ID NO: 734 - RNA, 20 nt, Artificial Sequence
  Guide Sequence
gcgcgggggccgcacgguaa

SEQ ID NO: 735 - RNA, 20 nt, Artificial Sequence
  Guide Sequence
gcgggggccgcacgguaagc

SEQ ID NO: 736 - RNA, 20 nt, Artificial Sequence
  Guide Sequence
gcuuaccgugcggcccccgc

SEQ ID NO: 737 - RNA, 20 nt, Artificial Sequence
  Guide Sequence
ggggccgcacgguaagcggg

SEQ ID NO: 738 - RNA, 20 nt, Artificial Sequence
  Guide Sequence
gggggccgcacgguaagcgg

SEQ ID NO: 739 - RNA, 20 nt, Artificial Sequence
  Guide Sequence
uaccgugcggcccccgcgcu

SEQ ID NO: 740 - RNA, 20 nt, Artificial Sequence
  Guide Sequence
uccccuggcuggcagcgcgg

SEQ ID NO: 741 - RNA, 20 nt, Artificial Sequence
  Guide Sequence
uuaccgugcggcccccgcgc

SEQ ID NO: 742 - RNA, 20 nt, Artificial Sequence
  Guide Sequence
uuccccuggcuggcagcgcg

SEQ ID NO: 743 - RNA, 20 nt, Artificial Sequence
  Guide Sequence
uuuccccuggcuggcagcgc

SEQ ID NO: 744 - RNA, 21 nt, Artificial Sequence
  Guide Sequence
agcccccgcuuaccgugcggc

SEQ ID NO: 745 - RNA, 21 nt, Artificial Sequence
  Guide Sequence
agcgcgggggccgcacgguaa

SEQ ID NO: 746 - RNA, 21 nt, Artificial Sequence
  Guide Sequence
ccuuuccccuggcuggcagcg

SEQ ID NO: 747 - RNA, 21 nt, Artificial Sequence
  Guide Sequence
cuuuccccuggcuggcagcgc

SEQ ID NO: 748 - RNA, 21 nt, Artificial Sequence
  Guide Sequence
gagcccccgcuuaccgugcgg

SEQ ID NO: 749 - RNA, 21 nt, Artificial Sequence
  Guide Sequence
ggagcccccgcuuaccgugcg

SEQ ID NO: 750 - RNA, 21 nt, Artificial Sequence
  Guide Sequence
uuaccgugcggcccccgcgcu

SEQ ID NO: 751 - RNA, 21 nt, Artificial Sequence
  Guide Sequence
uuccccuggcuggcagcgcgg

SEQ ID NO: 752 - RNA, 21 nt, Artificial Sequence
  Guide Sequence
uuuccccuggcuggcagcgcg

SEQ ID NO: 753 - RNA, 22 nt, Artificial Sequence
  Guide Sequence
agcccccgcuuaccgugcggcc

SEQ ID NO: 754 - RNA, 22 nt, Artificial Sequence
  Guide Sequence
agcgcgggggccgcacgguaag

SEQ ID NO: 755 - RNA, 22 nt, Artificial Sequence
  Guide Sequence
cagcgcgggggccgcacgguaa

SEQ ID NO: 756 - RNA, 22 nt, Artificial Sequence
  Guide Sequence
cccuuuccccuggcuggcagcg

SEQ ID NO: 757 - RNA, 22 nt, Artificial Sequence
  Guide Sequence
ccuuuccccuggcuggcagcgc

SEQ ID NO: 758 - RNA, 22 nt, Artificial Sequence
  Guide Sequence
cggagcccccgcuuaccgugcg

SEQ ID NO: 759 - RNA, 22 nt, Artificial Sequence
  Guide Sequence
cuuaccgugcggcccccgcgcu

SEQ ID NO: 760 - RNA, 22 nt, Artificial Sequence
  Guide Sequence
cuuuccccuggcuggcagcgcg

SEQ ID NO: 761 - RNA, 22 nt, Artificial Sequence
  Guide Sequence
gagcccccgcuuaccgugcggc

SEQ ID NO: 762 - RNA, 22 nt, Artificial Sequence
  Guide Sequence
ggagcccccgcuuaccgugcgg

SEQ ID NO: 763 - RNA, 22 nt, Artificial Sequence
  Guide Sequence
uuaccgugcggcccccgcgcug

SEQ ID NO: 764 - RNA, 22 nt, Artificial Sequence
  Guide Sequence
uuccccuggcuggcagcgcggg

SEQ ID NO: 765 - RNA, 22 nt, Artificial Sequence
  Guide Sequence
uuuccccuggcuggcagcgcgg

SEQ ID NO: 766 - RNA, 20 nt, Artificial Sequence
  Guide Sequence
aagcgggggcuucgagcugg

SEQ ID NO: 767 - RNA, 20 nt, Artificial Sequence
  Guide Sequence
acgguaagcgggggcuucga

SEQ ID NO: 768 - RNA, 20 nt, Artificial Sequence
  Guide Sequence
agcgggggcuucgagcugga

SEQ ID NO: 769 - RNA, 20 nt, Artificial Sequence
  Guide Sequence
agcucgaagcccccgcuuac

SEQ ID NO: 770 - RNA, 20 nt, Artificial Sequence
  Guide Sequence
aggccgcacgguaagcgggg

SEQ ID NO: 771 - RNA, 20 nt, Artificial Sequence
  Guide Sequence
cacgguaagcgggggcuucg

SEQ ID NO: 772 - RNA, 20 nt, Artificial Sequence
  Guide Sequence
cagcucgaagcccccgcuua

SEQ ID NO: 773 - RNA, 20 nt, Artificial Sequence
  Guide Sequence
ccagcucgaagcccccgcuu

SEQ ID NO: 774 - RNA, 20 nt, Artificial Sequence
  Guide Sequence
cccgguccagcucgaagccc

SEQ ID NO: 775 - RNA, 20 nt, Artificial Sequence
  Guide Sequence
ccgcacgguaagcgggggcu

SEQ ID NO: 776 - RNA, 20 nt, Artificial Sequence
  Guide Sequence
ccgguccagcucgaagcccc

SEQ ID NO: 777 - RNA, 20 nt, Artificial Sequence
  Guide Sequence
ccucgcgcccgguccagcuc

SEQ ID NO: 778 - RNA, 20 nt, Artificial Sequence
  Guide Sequence
cgaagcccccgcuuaccgug

SEQ ID NO: 779 - RNA, 20 nt, Artificial Sequence
  Guide Sequence
cgcacgguaagcgggggcuu

SEQ ID NO: 780 - RNA, 20 nt, Artificial Sequence
  Guide Sequence
cgcccgguccagcucgaagc

SEQ ID NO: 781 - RNA, 20 nt, Artificial Sequence
  Guide Sequence
cgcgcccgguccagcucgaa

SEQ ID NO: 782 - RNA, 20 nt, Artificial Sequence
  Guide Sequence
cgggggcuucgagcuggacc

SEQ ID NO: 783 - RNA, 20 nt, Artificial Sequence
  Guide Sequence
cgguaagcgggggcuucgag

SEQ ID NO: 784 - RNA, 20 nt, Artificial Sequence
  Guide Sequence
cgguccagcucgaagccccc

SEQ ID NO: 785 - RNA, 20 nt, Artificial Sequence
  Guide Sequence
cucgaagcccccgcuuaccg

SEQ ID NO: 786 - RNA, 20 nt, Artificial Sequence
  Guide Sequence
cucgcgcccgguccagcucg

SEQ ID NO: 787 - RNA, 20 nt, Artificial Sequence
  Guide Sequence
cuucgagcuggaccgggcgc

SEQ ID NO: 788 - RNA, 20 nt, Artificial Sequence
  Guide Sequence
gaagcccccgcuuaccgugc

SEQ ID NO: 789 - RNA, 20 nt, Artificial Sequence
  Guide Sequence
gcacgguaagcgggggcuuc

SEQ ID NO: 790 - RNA, 20 nt, Artificial Sequence
  Guide Sequence
gcccgguccagcucgaagcc

SEQ ID NO: 791 - RNA, 20 nt, Artificial Sequence
  Guide Sequence
gccgcacgguaagcgggggc

SEQ ID NO: 792 - RNA, 20 nt, Artificial Sequence
  Guide Sequence
gccucgcgcccgguccagcu

SEQ ID NO: 793 - RNA, 20 nt, Artificial Sequence
  Guide Sequence
gcgcccgguccagcucgaag

SEQ ID NO: 794 - RNA, 20 nt, Artificial Sequence
  Guide Sequence
gcgggggcuucgagcuggac

SEQ ID NO: 795 - RNA, 20 nt, Artificial Sequence
  Guide Sequence
gcucgaagcccccgcuuacc

SEQ ID NO: 796 - RNA, 20 nt, Artificial Sequence
  Guide Sequence
gcuucgagcuggaccgggcg

SEQ ID NO: 797 - RNA, 20 nt, Artificial Sequence
  Guide Sequence
ggccgcacgguaagcggggg

SEQ ID NO: 798 - RNA, 20 nt, Artificial Sequence
  Guide Sequence
ggcuucgagcuggaccgggc

SEQ ID NO: 799 - RNA, 20 nt, Artificial Sequence
  Guide Sequence
gggcuucgagcuggaccggg

SEQ ID NO: 800 - RNA, 20 nt, Artificial Sequence
  Guide Sequence
ggggcuucgagcuggaccgg

SEQ ID NO: 801 - RNA, 20 nt, Artificial Sequence
  Guide Sequence
gggggcuucgagcuggaccg

SEQ ID NO: 802 - RNA, 20 nt, Artificial Sequence
  Guide Sequence
gguaagcgggggcuucgagc

SEQ ID NO: 803 - RNA, 20 nt, Artificial Sequence
  Guide Sequence
gguccagcucgaagcccccg

SEQ ID NO: 804 - RNA, 20 nt, Artificial Sequence
  Guide Sequence
guaagcgggggcuucgagcu

SEQ ID NO: 805 - RNA, 20 nt, Artificial Sequence
  Guide Sequence
guccagcucgaagcccccgc

SEQ ID NO: 806 - RNA, 20 nt, Artificial Sequence
  Guide Sequence
uaagcgggggcuucgagcug

SEQ ID NO: 807 - RNA, 20 nt, Artificial Sequence
  Guide Sequence
uccagcucgaagcccccgcu

SEQ ID NO: 808 - RNA, 20 nt, Artificial Sequence
  Guide Sequence
ucgaagcccccgcuuaccgu

SEQ ID NO: 809 - RNA, 20 nt, Artificial Sequence
  Guide Sequence
ucgcgcccgguccagcucga

SEQ ID NO: 810 - RNA, 20 nt, Artificial Sequence
  Guide Sequence
uucgagcuggaccgggcgcg

SEQ ID NO: 811 - RNA, 21 nt, Artificial Sequence
  Guide Sequence
aagcgggggcuucgagcugga

SEQ ID NO: 812 - RNA, 21 nt, Artificial Sequence
  Guide Sequence
acgguaagcgggggcuucgag

SEQ ID NO: 813 - RNA, 21 nt, Artificial Sequence
  Guide Sequence
agcgggggcuucgagcuggac

SEQ ID NO: 814 - RNA, 21 nt, Artificial Sequence
  Guide Sequence
agcucgaagcccccgcuuacc

SEQ ID NO: 815 - RNA, 21 nt, Artificial Sequence
  Guide Sequence
aggccgcacgguaagcggggg

SEQ ID NO: 816 - RNA, 21 nt, Artificial Sequence
  Guide Sequence
cacgguaagcgggggcuucga

SEQ ID NO: 817 - RNA, 21 nt, Artificial Sequence
  Guide Sequence
cagcucgaagcccccgcuuac

SEQ ID NO: 818 - RNA, 21 nt, Artificial Sequence
  Guide Sequence
ccagcucgaagcccccgcuua

SEQ ID NO: 819 - RNA, 21 nt, Artificial Sequence
  Guide Sequence
cccgguccagcucgaagcccc

SEQ ID NO: 820 - RNA, 21 nt, Artificial Sequence
  Guide Sequence
ccgcacgguaagcgggggcuu

SEQ ID NO: 821 - RNA, 21 nt, Artificial Sequence
  Guide Sequence
ccgguccagcucgaagccccc

SEQ ID NO: 822 - RNA, 21 nt, Artificial Sequence
  Guide Sequence
cgaagcccccgcuuaccgugc

SEQ ID NO: 823 - RNA, 21 nt, Artificial Sequence
  Guide Sequence
cgcacgguaagcgggggcuuc

SEQ ID NO: 824 - RNA, 21 nt, Artificial Sequence
  Guide Sequence
cgcccgguccagcucgaagcc

SEQ ID NO: 825 - RNA, 21 nt, Artificial Sequence
  Guide Sequence
cgcgcccgguccagcucgaag

SEQ ID NO: 826 - RNA, 21 nt, Artificial Sequence
  Guide Sequence
cgggggcuucgagcuggaccg

SEQ ID NO: 827 - RNA, 21 nt, Artificial Sequence
  Guide Sequence
cgguaagcgggggcuucgagc

SEQ ID NO: 828 - RNA, 21 nt, Artificial Sequence
  Guide Sequence
cgguccagcucgaagcccccg

SEQ ID NO: 829 - RNA, 21 nt, Artificial Sequence
  Guide Sequence
cucgaagcccccgcuuaccgu

SEQ ID NO: 830 - RNA, 21 nt, Artificial Sequence
  Guide Sequence
cucgcgcccgguccagcucga

SEQ ID NO: 831 - RNA, 21 nt, Artificial Sequence
  Guide Sequence
cuucgagcuggaccgggcgcg

SEQ ID NO: 832 - RNA, 21 nt, Artificial Sequence
  Guide Sequence
gaagcccccgcuuaccgugcg

SEQ ID NO: 833 - RNA, 21 nt, Artificial Sequence
  Guide Sequence
gaggccgcacgguaagcgggg

SEQ ID NO: 834 - RNA, 21 nt, Artificial Sequence
  Guide Sequence
gcacgguaagcgggggcuucg

SEQ ID NO: 835 - RNA, 21 nt, Artificial Sequence
  Guide Sequence
gcccgguccagcucgaagccc

SEQ ID NO: 836 - RNA, 21 nt, Artificial Sequence
  Guide Sequence
gccgcacgguaagcgggggcu

SEQ ID NO: 837 - RNA, 21 nt, Artificial Sequence
  Guide Sequence
gcgcccgguccagcucgaagc

SEQ ID NO: 838 - RNA, 21 nt, Artificial Sequence
  Guide Sequence
gcgggggcuucgagcuggacc

SEQ ID NO: 839 - RNA, 21 nt, Artificial Sequence
  Guide Sequence
gcucgaagcccccgcuuaccg

SEQ ID NO: 840 - RNA, 21 nt, Artificial Sequence
  Guide Sequence
gcuucgagcuggaccgggcgc

SEQ ID NO: 841 - RNA, 21 nt, Artificial Sequence
  Guide Sequence
ggcuucgagcuggaccgggcg

SEQ ID NO: 842 - RNA, 21 nt, Artificial Sequence
  Guide Sequence
gggcuucgagcuggaccgggc

SEQ ID NO: 843 - RNA, 21 nt, Artificial Sequence
  Guide Sequence
ggggcuucgagcuggaccggg

SEQ ID NO: 844 - RNA, 21 nt, Artificial Sequence
  Guide Sequence
gggggcuucgagcuggaccgg

SEQ ID NO: 845 - RNA, 21 nt, Artificial Sequence
  Guide Sequence
gguaagcgggggcuucgagcu

SEQ ID NO: 846 - RNA, 21 nt, Artificial Sequence
  Guide Sequence
gguccagcucgaagcccccgc

SEQ ID NO: 847 - RNA, 21 nt, Artificial Sequence
  Guide Sequence
guaagcgggggcuucgagcug

SEQ ID NO: 848 - RNA, 21 nt, Artificial Sequence
  Guide Sequence
guccagcucgaagcccccgcu

SEQ ID NO: 849 - RNA, 21 nt, Artificial Sequence
  Guide Sequence
uaagcgggggcuucgagcugg

SEQ ID NO: 850 - RNA, 21 nt, Artificial Sequence
  Guide Sequence
uccagcucgaagcccccgcuu

SEQ ID NO: 851 - RNA, 21 nt, Artificial Sequence
  Guide Sequence
ucgaagcccccgcuuaccgug

SEQ ID NO: 852 - RNA, 21 nt, Artificial Sequence
  Guide Sequence
ucgcgcccgguccagcucgaa

SEQ ID NO: 853 - RNA, 21 nt, Artificial Sequence
  Guide Sequence
uucgagcuggaccgggcgcga

SEQ ID NO: 854 - RNA, 22 nt, Artificial Sequence
  Guide Sequence
aagcgggggcuucgagcuggac

SEQ ID NO: 855 - RNA, 22 nt, Artificial Sequence
  Guide Sequence
acgguaagcgggggcuucgagc

SEQ ID NO: 856 - RNA, 22 nt, Artificial Sequence
  Guide Sequence
agcgggggcuucgagcuggacc

SEQ ID NO: 857 - RNA, 22 nt, Artificial Sequence
  Guide Sequence
agcucgaagcccccgcuuaccg

SEQ ID NO: 858 - RNA, 22 nt, Artificial Sequence
  Guide Sequence
aggccgcacgguaagcgggggc

SEQ ID NO: 859 - RNA, 22 nt, Artificial Sequence
  Guide Sequence
cacgguaagcgggggcuucgag

SEQ ID NO: 860 - RNA, 22 nt, Artificial Sequence
  Guide Sequence
cagcucgaagcccccgcuuacc

SEQ ID NO: 861 - RNA, 22 nt, Artificial Sequence
  Guide Sequence
ccagcucgaagcccccgcuuac

SEQ ID NO: 862 - RNA, 22 nt, Artificial Sequence
  Guide Sequence
cccgguccagcucgaagccccc

SEQ ID NO: 863 - RNA, 22 nt, Artificial Sequence
  Guide Sequence
ccgcacgguaagcgggggcuuc

SEQ ID NO: 864 - RNA, 22 nt, Artificial Sequence
  Guide Sequence
ccgguccagcucgaagcccccg

SEQ ID NO: 865 - RNA, 22 nt, Artificial Sequence
  Guide Sequence
ccucgcgcccgguccagcucga

SEQ ID NO: 866 - RNA, 22 nt, Artificial Sequence
  Guide Sequence
cgaagcccccgcuuaccgugcg

SEQ ID NO: 867 - RNA, 22 nt, Artificial Sequence
  Guide Sequence
cgcacgguaagcgggggcuucg

SEQ ID NO: 868 - RNA, 22 nt, Artificial Sequence
  Guide Sequence
cgcccgguccagcucgaagccc

SEQ ID NO: 869 - RNA, 22 nt, Artificial Sequence
  Guide Sequence
cgcgcccgguccagcucgaagc

SEQ ID NO: 870 - RNA, 22 nt, Artificial Sequence
  Guide Sequence
cgggggcuucgagcuggaccgg

SEQ ID NO: 871 - RNA, 22 nt, Artificial Sequence
  Guide Sequence
cgguaagcgggggcuucgagcu

SEQ ID NO: 872 - RNA, 22 nt, Artificial Sequence
  Guide Sequence
cgguccagcucgaagcccccgc

SEQ ID NO: 873 - RNA, 22 nt, Artificial Sequence
  Guide Sequence
cucgaagcccccgcuuaccgug

SEQ ID NO: 874 - RNA, 22 nt, Artificial Sequence
  Guide Sequence
cucgcgcccgguccagcucgaa

SEQ ID NO: 875 - RNA, 22 nt, Artificial Sequence
  Guide Sequence
cuucgagcuggaccgggcgcga

SEQ ID NO: 876 - RNA, 22 nt, Artificial Sequence
  Guide Sequence
gaagcccccgcuuaccgugcgg

SEQ ID NO: 877 - RNA, 22 nt, Artificial Sequence
  Guide Sequence
gaggccgcacgguaagcggggg

SEQ ID NO: 878 - RNA, 22 nt, Artificial Sequence
  Guide Sequence
gcacgguaagcgggggcuucga

SEQ ID NO: 879 - RNA, 22 nt, Artificial Sequence
  Guide Sequence
gcccgguccagcucgaagcccc

SEQ ID NO: 880 - RNA, 22 nt, Artificial Sequence
  Guide Sequence
gccgcacgguaagcgggggcuu

SEQ ID NO: 881 - RNA, 22 nt, Artificial Sequence
  Guide Sequence
gcgcccgguccagcucgaagcc

SEQ ID NO: 882 - RNA, 22 nt, Artificial Sequence
  Guide Sequence
gcgggggcuucgagcuggaccg

SEQ ID NO: 883 - RNA, 22 nt, Artificial Sequence
  Guide Sequence
gcucgaagcccccgcuuaccgu

SEQ ID NO: 884 - RNA, 22 nt, Artificial Sequence
  Guide Sequence
gcuucgagcuggaccgggcgcg

SEQ ID NO: 885 - RNA, 22 nt, Artificial Sequence
  Guide Sequence
ggaggccgcacgguaagcgggg

SEQ ID NO: 886 - RNA, 22 nt, Artificial Sequence
  Guide Sequence
ggccgcacgguaagcgggggcu

SEQ ID NO: 887 - RNA, 22 nt, Artificial Sequence
  Guide Sequence
ggcuucgagcuggaccgggcgc

SEQ ID NO: 888 - RNA, 22 nt, Artificial Sequence
  Guide Sequence
gggcuucgagcuggaccgggcg

SEQ ID NO: 889 - RNA, 22 nt, Artificial Sequence
  Guide Sequence
ggggcuucgagcuggaccgggc

SEQ ID NO: 890 - RNA, 22 nt, Artificial Sequence
  Guide Sequence
gggggcuucgagcuggaccggg

SEQ ID NO: 891 - RNA, 22 nt, Artificial Sequence
  Guide Sequence
gguaagcgggggcuucgagcug

SEQ ID NO: 892 - RNA, 22 nt, Artificial Sequence
  Guide Sequence
gguccagcucgaagcccccgcu

SEQ ID NO: 893 - RNA, 22 nt, Artificial Sequence
  Guide Sequence
guaagcgggggcuucgagcugg

SEQ ID NO: 894 - RNA, 22 nt, Artificial Sequence
  Guide Sequence
guccagcucgaagcccccgcuu

SEQ ID NO: 895 - RNA, 22 nt, Artificial Sequence
  Guide Sequence
uaagcgggggcuucgagcugga

SEQ ID NO: 896 - RNA, 22 nt, Artificial Sequence
  Guide Sequence
uccagcucgaagcccccgcuua

SEQ ID NO: 897 - RNA, 22 nt, Artificial Sequence
  Guide Sequence
ucgaagcccccgcuuaccgugc

SEQ ID NO: 898 - RNA, 22 nt, Artificial Sequence
  Guide Sequence
ucgcgcccgguccagcucgaag

SEQ ID NO: 899 - RNA, 22 nt, Artificial Sequence
  Guide Sequence
uucgagcuggaccgggcgcgag

SEQ ID NO: 900 - RNA, 20 nt, Artificial Sequence
  Guide Sequence
aacuccaggcaucugaggga

SEQ ID NO: 901 - RNA, 20 nt, Artificial Sequence
  Guide Sequence
acaugcuugacuuuaucccu

SEQ ID NO: 902 - RNA, 20 nt, Artificial Sequence
  Guide Sequence
acuccaggcaucugagggau

SEQ ID NO: 903 - RNA, 20 nt, Artificial Sequence
  Guide Sequence
acuuuaucccucagaugccu

SEQ ID NO: 904 - RNA, 20 nt, Artificial Sequence
  Guide Sequence
aggcaucugagggauaaagu

SEQ ID NO: 905 - RNA, 20 nt, Artificial Sequence
  Guide Sequence
agggauaaagucaagcaugu

SEQ ID NO: 906 - RNA, 20 nt, Artificial Sequence
  Guide Sequence
aguaacuccaggcaucugag

SEQ ID NO: 907 - RNA, 20 nt, Artificial Sequence
  Guide Sequence
auaaagucaagcaugugaac

SEQ ID NO: 908 - RNA, 20 nt, Artificial Sequence
  Guide Sequence
aucugagggauaaagucaag

SEQ ID NO: 909 - RNA, 20 nt, Artificial Sequence
  Guide Sequence
augcuugacuuuaucccuca

SEQ ID NO: 910 - RNA, 20 nt, Artificial Sequence
  Guide Sequence
cacaugcuugacuuuauccc

SEQ ID NO: 911 - RNA, 20 nt, Artificial Sequence
  Guide Sequence
caggcaucugagggauaaag

SEQ ID NO: 912 - RNA, 20 nt, Artificial Sequence
  Guide Sequence
caucugagggauaaagucaa

SEQ ID NO: 913 - RNA, 20 nt, Artificial Sequence
  Guide Sequence
caugcuugacuuuaucccuc

SEQ ID NO: 914 - RNA, 20 nt, Artificial Sequence
  Guide Sequence
ccaggcaucugagggauaaa

SEQ ID NO: 915 - RNA, 20 nt, Artificial Sequence
  Guide Sequence
ccuguguucacaugcuugac

SEQ ID NO: 916 - RNA, 20 nt, Artificial Sequence
  Guide Sequence
cuccaggcaucugagggaua

SEQ ID NO: 917 - RNA, 20 nt, Artificial Sequence
  Guide Sequence
cugagggauaaagucaagca

SEQ ID NO: 918 - RNA, 20 nt, Artificial Sequence
  Guide Sequence
cuguguucacaugcuugacu

SEQ ID NO: 919 - RNA, 20 nt, Artificial Sequence
  Guide Sequence
cuugacuuuaucccucagau

SEQ ID NO: 920 - RNA, 20 nt, Artificial Sequence
  Guide Sequence
cuuuaucccucagaugccug

SEQ ID NO: 921 - RNA, 20 nt, Artificial Sequence
  Guide Sequence
gacuuuaucccucagaugcc

SEQ ID NO: 922 - RNA, 20 nt, Artificial Sequence
  Guide Sequence
gagggauaaagucaagcaug

SEQ ID NO: 923 - RNA, 20 nt, Artificial Sequence
  Guide Sequence
gauaaagucaagcaugugaa

SEQ ID NO: 924 - RNA, 20 nt, Artificial Sequence
  Guide Sequence
gcaucugagggauaaaguca

SEQ ID NO: 925 - RNA, 20 nt, Artificial Sequence
  Guide Sequence
gcuugacuuuaucccucaga

SEQ ID NO: 926 - RNA, 20 nt, Artificial Sequence
  Guide Sequence
ggauaaagucaagcauguga

SEQ ID NO: 927 - RNA, 20 nt, Artificial Sequence
  Guide Sequence
ggcaucugagggauaaaguc

SEQ ID NO: 928 - RNA, 20 nt, Artificial Sequence
  Guide Sequence
gggauaaagucaagcaugug

SEQ ID NO: 929 - RNA, 20 nt, Artificial Sequence
  Guide Sequence
guaacuccaggcaucugagg

SEQ ID NO: 930 - RNA, 20 nt, Artificial Sequence
  Guide Sequence
guguucacaugcuugacuuu

SEQ ID NO: 931 - RNA, 20 nt, Artificial Sequence
  Guide Sequence
guucacaugcuugacuuuau

SEQ ID NO: 932 - RNA, 20 nt, Artificial Sequence
  Guide Sequence
uaacuccaggcaucugaggg

SEQ ID NO: 933 - RNA, 20 nt, Artificial Sequence
  Guide Sequence
uaucccucagaugccuggag

SEQ ID NO: 934 - RNA, 20 nt, Artificial Sequence
  Guide Sequence
ucacaugcuugacuuuaucc

SEQ ID NO: 935 - RNA, 20 nt, Artificial Sequence
  Guide Sequence
uccaggcaucugagggauaa

SEQ ID NO: 936 - RNA, 20 nt, Artificial Sequence
  Guide Sequence
ucugagggauaaagucaagc

SEQ ID NO: 937 - RNA, 20 nt, Artificial Sequence
  Guide Sequence
ugacuuuaucccucagaugc

SEQ ID NO: 938 - RNA, 20 nt, Artificial Sequence
  Guide Sequence
ugagggauaaagucaagcau

SEQ ID NO: 939 - RNA, 20 nt, Artificial Sequence
  Guide Sequence
ugcuugacuuuaucccucag

SEQ ID NO: 940 - RNA, 20 nt, Artificial Sequence
  Guide Sequence
uguguucacaugcuugacuu

SEQ ID NO: 941 - RNA, 20 nt, Artificial Sequence
  Guide Sequence
uguucacaugcuugacuuua

SEQ ID NO: 942 - RNA, 20 nt, Artificial Sequence
  Guide Sequence
uuaucccucagaugccugga

SEQ ID NO: 943 - RNA, 20 nt, Artificial Sequence
  Guide Sequence
uucacaugcuugacuuuauc

SEQ ID NO: 944 - RNA, 20 nt, Artificial Sequence
  Guide Sequence
uugacuuuaucccucagaug

SEQ ID NO: 945 - RNA, 20 nt, Artificial Sequence
  Guide Sequence
uuuaucccucagaugccugg

SEQ ID NO: 946 - RNA, 21 nt, Artificial Sequence
  Guide Sequence
aacuccaggcaucugagggau

SEQ ID NO: 947 - RNA, 21 nt, Artificial Sequence
  Guide Sequence
acaugcuugacuuuaucccuc

SEQ ID NO: 948 - RNA, 21 nt, Artificial Sequence
  Guide Sequence
acuccaggcaucugagggaua

SEQ ID NO: 949 - RNA, 21 nt, Artificial Sequence
  Guide Sequence
acuuuaucccucagaugccug

SEQ ID NO: 950 - RNA, 21 nt, Artificial Sequence
  Guide Sequence
aggcaucugagggauaaaguc

SEQ ID NO: 951 - RNA, 21 nt, Artificial Sequence
  Guide Sequence
agggauaaagucaagcaugug

SEQ ID NO: 952 - RNA, 21 nt, Artificial Sequence
  Guide Sequence
aguaacuccaggcaucugagg

SEQ ID NO: 953 - RNA, 21 nt, Artificial Sequence
  Guide Sequence
auaaagucaagcaugugaaca

SEQ ID NO: 954 - RNA, 21 nt, Artificial Sequence
  Guide Sequence
aucugagggauaaagucaagc

SEQ ID NO: 955 - RNA, 21 nt, Artificial Sequence
  Guide Sequence
augcuugacuuuaucccucag

SEQ ID NO: 956 - RNA, 21 nt, Artificial Sequence
  Guide Sequence
cacaugcuugacuuuaucccu

SEQ ID NO: 957 - RNA, 21 nt, Artificial Sequence
  Guide Sequence
caggcaucugagggauaaagu

SEQ ID NO: 958 - RNA, 21 nt, Artificial Sequence
  Guide Sequence
caguaacuccaggcaucugag

SEQ ID NO: 959 - RNA, 21 nt, Artificial Sequence
  Guide Sequence
caucugagggauaaagucaag

SEQ ID NO: 960 - RNA, 21 nt, Artificial Sequence
  Guide Sequence
caugcuugacuuuaucccuca

SEQ ID NO: 961 - RNA, 21 nt, Artificial Sequence
  Guide Sequence
ccaggcaucugagggauaaag

SEQ ID NO: 962 - RNA, 21 nt, Artificial Sequence
  Guide Sequence
ccuguguucacaugcuugacu

SEQ ID NO: 963 - RNA, 21 nt, Artificial Sequence
  Guide Sequence
cuccaggcaucugagggauaa

SEQ ID NO: 964 - RNA, 21 nt, Artificial Sequence
  Guide Sequence
cugagggauaaagucaagcau

SEQ ID NO: 965 - RNA, 21 nt, Artificial Sequence
  Guide Sequence
cuguguucacaugcuugacuu

SEQ ID NO: 966 - RNA, 21 nt, Artificial Sequence
  Guide Sequence
cuugacuuuaucccucagaug

SEQ ID NO: 967 - RNA, 21 nt, Artificial Sequence
  Guide Sequence
cuuuaucccucagaugccugg

SEQ ID NO: 968 - RNA, 21 nt, Artificial Sequence
  Guide Sequence
gacuuuaucccucagaugccu

SEQ ID NO: 969 - RNA, 21 nt, Artificial Sequence
  Guide Sequence
gagggauaaagucaagcaugu

SEQ ID NO: 970 - RNA, 21 nt, Artificial Sequence
  Guide Sequence
gauaaagucaagcaugugaac

SEQ ID NO: 971 - RNA, 21 nt, Artificial Sequence
  Guide Sequence
gcaucugagggauaaagucaa

SEQ ID NO: 972 - RNA, 21 nt, Artificial Sequence
  Guide Sequence
gccuguguucacaugcuugac

SEQ ID NO: 973 - RNA, 21 nt, Artificial Sequence
  Guide Sequence
gcuugacuuuaucccucagau

SEQ ID NO: 974 - RNA, 21 nt, Artificial Sequence
  Guide Sequence
ggauaaagucaagcaugugaa

SEQ ID NO: 975 - RNA, 21 nt, Artificial Sequence
  Guide Sequence
ggcaucugagggauaaaguca

SEQ ID NO: 976 - RNA, 21 nt, Artificial Sequence
  Guide Sequence
gggauaaagucaagcauguga

SEQ ID NO: 977 - RNA, 21 nt, Artificial Sequence
  Guide Sequence
guaacuccaggcaucugaggg

SEQ ID NO: 978 - RNA, 21 nt, Artificial Sequence
  Guide Sequence
guguucacaugcuugacuuua

SEQ ID NO: 979 - RNA, 21 nt, Artificial Sequence
  Guide Sequence
guucacaugcuugacuuuauc

SEQ ID NO: 980 - RNA, 21 nt, Artificial Sequence
  Guide Sequence
uaacuccaggcaucugaggga

SEQ ID NO: 981 - RNA, 21 nt, Artificial Sequence
  Guide Sequence
uaucccucagaugccuggagu

SEQ ID NO: 982 - RNA, 21 nt, Artificial Sequence
  Guide Sequence
ucacaugcuugacuuuauccc

SEQ ID NO: 983 - RNA, 21 nt, Artificial Sequence
  Guide Sequence
uccaggcaucugagggauaaa

SEQ ID NO: 984 - RNA, 21 nt, Artificial Sequence
  Guide Sequence
ucugagggauaaagucaagca

SEQ ID NO: 985 - RNA, 21 nt, Artificial Sequence
  Guide Sequence
ugacuuuaucccucagaugcc

SEQ ID NO: 986 - RNA, 21 nt, Artificial Sequence
  Guide Sequence
ugagggauaaagucaagcaug

SEQ ID NO: 987 - RNA, 21 nt, Artificial Sequence
  Guide Sequence
ugcuugacuuuaucccucaga

SEQ ID NO: 988 - RNA, 21 nt, Artificial Sequence
  Guide Sequence
uguguucacaugcuugacuuu

SEQ ID NO: 989 - RNA, 21 nt, Artificial Sequence
  Guide Sequence
uguucacaugcuugacuuuau

SEQ ID NO: 990 - RNA, 21 nt, Artificial Sequence
  Guide Sequence
uuaucccucagaugccuggag

SEQ ID NO: 991 - RNA, 21 nt, Artificial Sequence
  Guide Sequence
uucacaugcuugacuuuaucc

SEQ ID NO: 992 - RNA, 21 nt, Artificial Sequence
  Guide Sequence
uugacuuuaucccucagaugc

SEQ ID NO: 993 - RNA, 21 nt, Artificial Sequence
  Guide Sequence
uuuaucccucagaugccugga

SEQ ID NO: 994 - RNA, 22 nt, Artificial Sequence
  Guide Sequence
aacuccaggcaucugagggaua

SEQ ID NO: 995 - RNA, 22 nt, Artificial Sequence
  Guide Sequence
acaguaacuccaggcaucugag

SEQ ID NO: 996 - RNA, 22 nt, Artificial Sequence
  Guide Sequence
acaugcuugacuuuaucccuca

SEQ ID NO: 997 - RNA, 22 nt, Artificial Sequence
  Guide Sequence
acuccaggcaucugagggauaa

SEQ ID NO: 998 - RNA, 22 nt, Artificial Sequence
  Guide Sequence
acuuuaucccucagaugccugg

SEQ ID NO: 999 - RNA, 22 nt, Artificial Sequence
  Guide Sequence
aggcaucugagggauaaaguca

SEQ ID NO: 1000 - RNA, 22 nt, Artificial Sequence
  Guide Sequence
agggauaaagucaagcauguga

SEQ ID NO: 1001 - RNA, 22 nt, Artificial Sequence
  Guide Sequence
aguaacuccaggcaucugaggg

SEQ ID NO: 1002 - RNA, 22 nt, Artificial Sequence
  Guide Sequence
auaaagucaagcaugugaacac

SEQ ID NO: 1003 - RNA, 22 nt, Artificial Sequence
  Guide Sequence
aucugagggauaaagucaagca

SEQ ID NO: 1004 - RNA, 22 nt, Artificial Sequence
  Guide Sequence
augcuugacuuuaucccucaga

SEQ ID NO: 1005 - RNA, 22 nt, Artificial Sequence
  Guide Sequence
cacaugcuugacuuuaucccuc

SEQ ID NO: 1006 - RNA, 22 nt, Artificial Sequence
  Guide Sequence
caggcaucugagggauaaaguc

SEQ ID NO: 1007 - RNA, 22 nt, Artificial Sequence
  Guide Sequence
caguaacuccaggcaucugagg

SEQ ID NO: 1008 - RNA, 22 nt, Artificial Sequence
  Guide Sequence
caucugagggauaaagucaagc

SEQ ID NO: 1009 - RNA, 22 nt, Artificial Sequence
  Guide Sequence
caugcuugacuuuaucccucag

SEQ ID NO: 1010 - RNA, 22 nt, Artificial Sequence
  Guide Sequence
ccaggcaucugagggauaaagu

SEQ ID NO: 1011 - RNA, 22 nt, Artificial Sequence
  Guide Sequence
ccuguguucacaugcuugacuu

SEQ ID NO: 1012 - RNA, 22 nt, Artificial Sequence
  Guide Sequence
cuccaggcaucugagggauaaa

SEQ ID NO: 1013 - RNA, 22 nt, Artificial Sequence
  Guide Sequence
cugagggauaaagucaagcaug

SEQ ID NO: 1014 - RNA, 22 nt, Artificial Sequence
  Guide Sequence
cuguguucacaugcuugacuuu

SEQ ID NO: 1015 - RNA, 22 nt, Artificial Sequence
  Guide Sequence
cuugacuuuaucccucagaugc

SEQ ID NO: 1016 - RNA, 22 nt, Artificial Sequence
  Guide Sequence
cuuuaucccucagaugccugga

SEQ ID NO: 1017 - RNA, 22 nt, Artificial Sequence
  Guide Sequence
gacuuuaucccucagaugccug

SEQ ID NO: 1018 - RNA, 22 nt, Artificial Sequence
  Guide Sequence
gagggauaaagucaagcaugug

SEQ ID NO: 1019 - RNA, 22 nt, Artificial Sequence
  Guide Sequence
gauaaagucaagcaugugaaca

SEQ ID NO: 1020 - RNA, 22 nt, Artificial Sequence
  Guide Sequence
gcaucugagggauaaagucaag

SEQ ID NO: 1021 - RNA, 22 nt, Artificial Sequence
  Guide Sequence
gccuguguucacaugcuugacu

SEQ ID NO: 1022 - RNA, 22 nt, Artificial Sequence
  Guide Sequence
gcuugacuuuaucccucagaug

SEQ ID NO: 1023 - RNA, 22 nt, Artificial Sequence
  Guide Sequence
ggauaaagucaagcaugugaac

SEQ ID NO: 1024 - RNA, 22 nt, Artificial Sequence
  Guide Sequence
ggcaucugagggauaaagucaa

SEQ ID NO: 1025 - RNA, 22 nt, Artificial Sequence
  Guide Sequence
ggccuguguucacaugcuugac

SEQ ID NO: 1026 - RNA, 22 nt, Artificial Sequence
  Guide Sequence
gggauaaagucaagcaugugaa

SEQ ID NO: 1027 - RNA, 22 nt, Artificial Sequence
  Guide Sequence
guaacuccaggcaucugaggga

SEQ ID NO: 1028 - RNA, 22 nt, Artificial Sequence
  Guide Sequence
guguucacaugcuugacuuuau

SEQ ID NO: 1029 - RNA, 22 nt, Artificial Sequence
  Guide Sequence
guucacaugcuugacuuuaucc

SEQ ID NO: 1030 - RNA, 22 nt, Artificial Sequence
  Guide Sequence
uaacuccaggcaucugagggau

SEQ ID NO: 1031 - RNA, 22 nt, Artificial Sequence
  Guide Sequence
uaucccucagaugccuggaguu

SEQ ID NO: 1032 - RNA, 22 nt, Artificial Sequence
  Guide Sequence
ucacaugcuugacuuuaucccu

SEQ ID NO: 1033 - RNA, 22 nt, Artificial Sequence
  Guide Sequence
uccaggcaucugagggauaaag

SEQ ID NO: 1034 - RNA, 22 nt, Artificial Sequence
  Guide Sequence
ucugagggauaaagucaagcau

SEQ ID NO: 1035 - RNA, 22 nt, Artificial Sequence
  Guide Sequence
ugacuuuaucccucagaugccu

SEQ ID NO: 1036 - RNA, 22 nt, Artificial Sequence
  Guide Sequence
ugagggauaaagucaagcaugu

SEQ ID NO: 1037 - RNA, 22 nt, Artificial Sequence
  Guide Sequence
ugcuugacuuuaucccucagau

SEQ ID NO: 1038 - RNA, 22 nt, Artificial Sequence
  Guide Sequence
uguguucacaugcuugacuuua

SEQ ID NO: 1039 - RNA, 22 nt, Artificial Sequence
  Guide Sequence
uguucacaugcuugacuuuauc

SEQ ID NO: 1040 - RNA, 22 nt, Artificial Sequence
  Guide Sequence
uuaucccucagaugccuggagu

SEQ ID NO: 1041 - RNA, 22 nt, Artificial Sequence
  Guide Sequence
uucacaugcuugacuuuauccc

SEQ ID NO: 1042 - RNA, 22 nt, Artificial Sequence
  Guide Sequence
uugacuuuaucccucagaugcc

SEQ ID NO: 1043 - RNA, 22 nt, Artificial Sequence
  Guide Sequence
uuuaucccucagaugccuggag

SEQ ID NO: 1044 - RNA, 20 nt, Artificial Sequence
  Guide Sequence
aacuccaggcaucugaggaa

SEQ ID NO: 1045 - RNA, 20 nt, Artificial Sequence
  Guide Sequence
acaguaacuccaggcaucug

SEQ ID NO: 1046 - RNA, 20 nt, Artificial Sequence
  Guide Sequence
acaugcuugacuuucuuccu

SEQ ID NO: 1047 - RNA, 20 nt, Artificial Sequence
  Guide Sequence
acuccaggcaucugaggaag

SEQ ID NO: 1048 - RNA, 20 nt, Artificial Sequence
  Guide Sequence
acuuucuuccucagaugccu

SEQ ID NO: 1049 - RNA, 20 nt, Artificial Sequence
  Guide Sequence
aggaagaaagucaagcaugu

SEQ ID NO: 1050 - RNA, 20 nt, Artificial Sequence
  Guide Sequence
aggcaucugaggaagaaagu

SEQ ID NO: 1051 - RNA, 20 nt, Artificial Sequence
  Guide Sequence
aucugaggaagaaagucaag

SEQ ID NO: 1052 - RNA, 20 nt, Artificial Sequence
  Guide Sequence
augcuugacuuucuuccuca

SEQ ID NO: 1053 - RNA, 20 nt, Artificial Sequence
  Guide Sequence
cacaugcuugacuuucuucc

SEQ ID NO: 1054 - RNA, 20 nt, Artificial Sequence
  Guide Sequence
caggcaucugaggaagaaag

SEQ ID NO: 1055 - RNA, 20 nt, Artificial Sequence
  Guide Sequence
caguaacuccaggcaucuga

SEQ ID NO: 1056 - RNA, 20 nt, Artificial Sequence
  Guide Sequence
caucugaggaagaaagucaa

SEQ ID NO: 1057 - RNA, 20 nt, Artificial Sequence
  Guide Sequence
caugcuugacuuucuuccuc

SEQ ID NO: 1058 - RNA, 20 nt, Artificial Sequence
  Guide Sequence
ccaggcaucugaggaagaaa

SEQ ID NO: 1059 - RNA, 20 nt, Artificial Sequence
  Guide Sequence
cuccaggcaucugaggaaga

SEQ ID NO: 1060 - RNA, 20 nt, Artificial Sequence
  Guide Sequence
cugaggaagaaagucaagca

SEQ ID NO: 1061 - RNA, 20 nt, Artificial Sequence
  Guide Sequence
cuuccucagaugccuggagu

SEQ ID NO: 1062 - RNA, 20 nt, Artificial Sequence
  Guide Sequence
cuugacuuucuuccucagau

SEQ ID NO: 1063 - RNA, 20 nt, Artificial Sequence
  Guide Sequence
cuuucuuccucagaugccug

SEQ ID NO: 1064 - RNA, 20 nt, Artificial Sequence
  Guide Sequence
gaagaaagucaagcauguga

SEQ ID NO: 1065 - RNA, 20 nt, Artificial Sequence
  Guide Sequence
gacuuucuuccucagaugcc

SEQ ID NO: 1066 - RNA, 20 nt, Artificial Sequence
  Guide Sequence
gaggaagaaagucaagcaug

SEQ ID NO: 1067 - RNA, 20 nt, Artificial Sequence
  Guide Sequence
gcaucugaggaagaaaguca

SEQ ID NO: 1068 - RNA, 20 nt, Artificial Sequence
  Guide Sequence
gcuugacuuucuuccucaga

SEQ ID NO: 1069 - RNA, 20 nt, Artificial Sequence
  Guide Sequence
ggaagaaagucaagcaugug

SEQ ID NO: 1070 - RNA, 20 nt, Artificial Sequence
  Guide Sequence
ggcaucugaggaagaaaguc

SEQ ID NO: 1071 - RNA, 20 nt, Artificial Sequence
  Guide Sequence
guucacaugcuugacuuucu

SEQ ID NO: 1072 - RNA, 20 nt, Artificial Sequence
  Guide Sequence
uaacuccaggcaucugagga

SEQ ID NO: 1073 - RNA, 20 nt, Artificial Sequence
  Guide Sequence
ucacaugcuugacuuucuuc

SEQ ID NO: 1074 - RNA, 20 nt, Artificial Sequence
  Guide Sequence
uccaggcaucugaggaagaa

SEQ ID NO: 1075 - RNA, 20 nt, Artificial Sequence
  Guide Sequence
ucugaggaagaaagucaagc

SEQ ID NO: 1076 - RNA, 20 nt, Artificial Sequence
  Guide Sequence
ucuuccucagaugccuggag

SEQ ID NO: 1077 - RNA, 20 nt, Artificial Sequence
  Guide Sequence
ugacuuucuuccucagaugc

SEQ ID NO: 1078 - RNA, 20 nt, Artificial Sequence
  Guide Sequence
ugaggaagaaagucaagcau

SEQ ID NO: 1079 - RNA, 20 nt, Artificial Sequence
  Guide Sequence
ugcuugacuuucuuccucag

SEQ ID NO: 1080 - RNA, 20 nt, Artificial Sequence
  Guide Sequence
uguucacaugcuugacuuuc

SEQ ID NO: 1081 - RNA, 20 nt, Artificial Sequence
  Guide Sequence
uucacaugcuugacuuucuu

SEQ ID NO: 1082 - RNA, 20 nt, Artificial Sequence
  Guide Sequence
uuccucagaugccuggaguu

SEQ ID NO: 1083 - RNA, 20 nt, Artificial Sequence
  Guide Sequence
uucuuccucagaugccugga

SEQ ID NO: 1084 - RNA, 20 nt, Artificial Sequence
  Guide Sequence
uugacuuucuuccucagaug

SEQ ID NO: 1085 - RNA, 20 nt, Artificial Sequence
  Guide Sequence
uuucuuccucagaugccugg

SEQ ID NO: 1086 - RNA, 21 nt, Artificial Sequence
  Guide Sequence
aacuccaggcaucugaggaag

SEQ ID NO: 1087 - RNA, 21 nt, Artificial Sequence
  Guide Sequence
acaguaacuccaggcaucuga

SEQ ID NO: 1088 - RNA, 21 nt, Artificial Sequence
  Guide Sequence
acaugcuugacuuucuuccuc

SEQ ID NO: 1089 - RNA, 21 nt, Artificial Sequence
  Guide Sequence
acuccaggcaucugaggaaga

SEQ ID NO: 1090 - RNA, 21 nt, Artificial Sequence
  Guide Sequence
acuuucuuccucagaugccug

SEQ ID NO: 1091 - RNA, 21 nt, Artificial Sequence
  Guide Sequence
aggaagaaagucaagcaugug

SEQ ID NO: 1092 - RNA, 21 nt, Artificial Sequence
  Guide Sequence
aggcaucugaggaagaaaguc

SEQ ID NO: 1093 - RNA, 21 nt, Artificial Sequence
  Guide Sequence
aucugaggaagaaagucaagc

SEQ ID NO: 1094 - RNA, 21 nt, Artificial Sequence
  Guide Sequence
augcuugacuuucuuccucag

SEQ ID NO: 1095 - RNA, 21 nt, Artificial Sequence
  Guide Sequence
cacaugcuugacuuucuuccu

SEQ ID NO: 1096 - RNA, 21 nt, Artificial Sequence
  Guide Sequence
caggcaucugaggaagaaagu

SEQ ID NO: 1097 - RNA, 21 nt, Artificial Sequence
  Guide Sequence
caucugaggaagaaagucaag

SEQ ID NO: 1098 - RNA, 21 nt, Artificial Sequence
  Guide Sequence
caugcuugacuuucuuccuca

SEQ ID NO: 1099 - RNA, 21 nt, Artificial Sequence
  Guide Sequence
ccaggcaucugaggaagaaag

SEQ ID NO: 1100 - RNA, 21 nt, Artificial Sequence
  Guide Sequence
cuccaggcaucugaggaagaa

SEQ ID NO: 1101 - RNA, 21 nt, Artificial Sequence
  Guide Sequence
cugaggaagaaagucaagcau

SEQ ID NO: 1102 - RNA, 21 nt, Artificial Sequence
  Guide Sequence
cuuccucagaugccuggaguu

SEQ ID NO: 1103 - RNA, 21 nt, Artificial Sequence
  Guide Sequence
cuugacuuucuuccucagaug

SEQ ID NO: 1104 - RNA, 21 nt, Artificial Sequence
  Guide Sequence
cuuucuuccucagaugccugg

SEQ ID NO: 1105 - RNA, 21 nt, Artificial Sequence
  Guide Sequence
gaagaaagucaagcaugugaa

SEQ ID NO: 1106 - RNA, 21 nt, Artificial Sequence
  Guide Sequence
gacuuucuuccucagaugccu

SEQ ID NO: 1107 - RNA, 21 nt, Artificial Sequence
  Guide Sequence
gaggaagaaagucaagcaugu

SEQ ID NO: 1108 - RNA, 21 nt, Artificial Sequence
  Guide Sequence
gcaucugaggaagaaagucaa

SEQ ID NO: 1109 - RNA, 21 nt, Artificial Sequence
  Guide Sequence
gcuugacuuucuuccucagau

SEQ ID NO: 1110 - RNA, 21 nt, Artificial Sequence
  Guide Sequence
ggaagaaagucaagcauguga

SEQ ID NO: 1111 - RNA, 21 nt, Artificial Sequence
  Guide Sequence
ggcaucugaggaagaaaguca

SEQ ID NO: 1112 - RNA, 21 nt, Artificial Sequence
  Guide Sequence
guaacuccaggcaucugagga

SEQ ID NO: 1113 - RNA, 21 nt, Artificial Sequence
  Guide Sequence
guguucacaugcuugacuuuc

SEQ ID NO: 1114 - RNA, 21 nt, Artificial Sequence
  Guide Sequence
guucacaugcuugacuuucuu

SEQ ID NO: 1115 - RNA, 21 nt, Artificial Sequence
  Guide Sequence
uaacuccaggcaucugaggaa

SEQ ID NO: 1116 - RNA, 21 nt, Artificial Sequence
  Guide Sequence
uacaguaacuccaggcaucug

SEQ ID NO: 1117 - RNA, 21 nt, Artificial Sequence
  Guide Sequence
ucacaugcuugacuuucuucc

SEQ ID NO: 1118 - RNA, 21 nt, Artificial Sequence
  Guide Sequence
uccaggcaucugaggaagaaa

SEQ ID NO: 1119 - RNA, 21 nt, Artificial Sequence
  Guide Sequence
ucugaggaagaaagucaagca

SEQ ID NO: 1120 - RNA, 21 nt, Artificial Sequence
  Guide Sequence
ucuuccucagaugccuggagu

SEQ ID NO: 1121 - RNA, 21 nt, Artificial Sequence
  Guide Sequence
ugacuuucuuccucagaugcc

SEQ ID NO: 1122 - RNA, 21 nt, Artificial Sequence
  Guide Sequence
ugaggaagaaagucaagcaug

SEQ ID NO: 1123 - RNA, 21 nt, Artificial Sequence
  Guide Sequence
ugcuugacuuucuuccucaga

SEQ ID NO: 1124 - RNA, 21 nt, Artificial Sequence
  Guide Sequence
uguucacaugcuugacuuucu

SEQ ID NO: 1125 - RNA, 21 nt, Artificial Sequence
  Guide Sequence
uucacaugcuugacuuucuuc

SEQ ID NO: 1126 - RNA, 21 nt, Artificial Sequence
  Guide Sequence
uuccucagaugccuggaguua

SEQ ID NO: 1127 - RNA, 21 nt, Artificial Sequence
  Guide Sequence
uucuuccucagaugccuggag

SEQ ID NO: 1128 - RNA, 21 nt, Artificial Sequence
  Guide Sequence
uugacuuucuuccucagaugc

SEQ ID NO: 1129 - RNA, 21 nt, Artificial Sequence
  Guide Sequence
uuucuuccucagaugccugga

SEQ ID NO: 1130 - RNA, 22 nt, Artificial Sequence
  Guide Sequence
aacuccaggcaucugaggaaga

SEQ ID NO: 1131 - RNA, 22 nt, Artificial Sequence
  Guide Sequence
acaugcuugacuuucuuccuca

SEQ ID NO: 1132 - RNA, 22 nt, Artificial Sequence
  Guide Sequence
acuccaggcaucugaggaagaa

SEQ ID NO: 1133 - RNA, 22 nt, Artificial Sequence
  Guide Sequence
acuuucuuccucagaugccugg

SEQ ID NO: 1134 - RNA, 22 nt, Artificial Sequence
  Guide Sequence
aggaagaaagucaagcauguga

SEQ ID NO: 1135 - RNA, 22 nt, Artificial Sequence
  Guide Sequence
aggcaucugaggaagaaaguca

SEQ ID NO: 1136 - RNA, 22 nt, Artificial Sequence
  Guide Sequence
aguaacuccaggcaucugagga

SEQ ID NO: 1137 - RNA, 22 nt, Artificial Sequence
  Guide Sequence
aucugaggaagaaagucaagca

SEQ ID NO: 1138 - RNA, 22 nt, Artificial Sequence
  Guide Sequence
augcuugacuuucuuccucaga

SEQ ID NO: 1139 - RNA, 22 nt, Artificial Sequence
  Guide Sequence
cacaugcuugacuuucuuccuc

SEQ ID NO: 1140 - RNA, 22 nt, Artificial Sequence
  Guide Sequence
caggcaucugaggaagaaaguc

SEQ ID NO: 1141 - RNA, 22 nt, Artificial Sequence
  Guide Sequence
caucugaggaagaaagucaagc

SEQ ID NO: 1142 - RNA, 22 nt, Artificial Sequence
  Guide Sequence
caugcuugacuuucuuccucag

SEQ ID NO: 1143 - RNA, 22 nt, Artificial Sequence
  Guide Sequence
ccaggcaucugaggaagaaagu

SEQ ID NO: 1144 - RNA, 22 nt, Artificial Sequence
  Guide Sequence
cuccaggcaucugaggaagaaa

SEQ ID NO: 1145 - RNA, 22 nt, Artificial Sequence
  Guide Sequence
cugaggaagaaagucaagcaug

SEQ ID NO: 1146 - RNA, 22 nt, Artificial Sequence
  Guide Sequence
cuuccucagaugccuggaguua

SEQ ID NO: 1147 - RNA, 22 nt, Artificial Sequence
  Guide Sequence
cuugacuuucuuccucagaugc

SEQ ID NO: 1148 - RNA, 22 nt, Artificial Sequence
  Guide Sequence
cuuucuuccucagaugccugga

SEQ ID NO: 1149 - RNA, 22 nt, Artificial Sequence
  Guide Sequence
gaagaaagucaagcaugugaac

SEQ ID NO: 1150 - RNA, 22 nt, Artificial Sequence
  Guide Sequence
gacuuucuuccucagaugccug

SEQ ID NO: 1151 - RNA, 22 nt, Artificial Sequence
  Guide Sequence
gaggaagaaagucaagcaugug

SEQ ID NO: 1152 - RNA, 22 nt, Artificial Sequence
  Guide Sequence
gcaucugaggaagaaagucaag

SEQ ID NO: 1153 - RNA, 22 nt, Artificial Sequence
  Guide Sequence
gcuugacuuucuuccucagaug

SEQ ID NO: 1154 - RNA, 22 nt, Artificial Sequence
  Guide Sequence
ggaagaaagucaagcaugugaa

SEQ ID NO: 1155 - RNA, 22 nt, Artificial Sequence
  Guide Sequence
ggcaucugaggaagaaagucaa

SEQ ID NO: 1156 - RNA, 22 nt, Artificial Sequence
  Guide Sequence
guaacuccaggcaucugaggaa

SEQ ID NO: 1157 - RNA, 22 nt, Artificial Sequence
  Guide Sequence
guguucacaugcuugacuuucu

SEQ ID NO: 1158 - RNA, 22 nt, Artificial Sequence
  Guide Sequence
guucacaugcuugacuuucuuc

SEQ ID NO: 1159 - RNA, 22 nt, Artificial Sequence
  Guide Sequence
uaacuccaggcaucugaggaag

SEQ ID NO: 1160 - RNA, 22 nt, Artificial Sequence
  Guide Sequence
uacaguaacuccaggcaucuga

SEQ ID NO: 1161 - RNA, 22 nt, Artificial Sequence
  Guide Sequence
ucacaugcuugacuuucuuccu

SEQ ID NO: 1162 - RNA, 22 nt, Artificial Sequence
  Guide Sequence
uccaggcaucugaggaagaaag

SEQ ID NO: 1163 - RNA, 22 nt, Artificial Sequence
  Guide Sequence
ucugaggaagaaagucaagcau

SEQ ID NO: 1164 - RNA, 22 nt, Artificial Sequence
  Guide Sequence
ucuuccucagaugccuggaguu

SEQ ID NO: 1165 - RNA, 22 nt, Artificial Sequence
  Guide Sequence
ugacuuucuuccucagaugccu

SEQ ID NO: 1166 - RNA, 22 nt, Artificial Sequence
  Guide Sequence
ugaggaagaaagucaagcaugu

SEQ ID NO: 1167 - RNA, 22 nt, Artificial Sequence
  Guide Sequence
ugcuugacuuucuuccucagau

SEQ ID NO: 1168 - RNA, 22 nt, Artificial Sequence
  Guide Sequence
uguguucacaugcuugacuuuc

SEQ ID NO: 1169 - RNA, 22 nt, Artificial Sequence
  Guide Sequence
uguucacaugcuugacuuucuu

SEQ ID NO: 1170 - RNA, 22 nt, Artificial Sequence
  Guide Sequence
uuacaguaacuccaggcaucug

SEQ ID NO: 1171 - RNA, 22 nt, Artificial Sequence
  Guide Sequence
uucacaugcuugacuuucuucc

SEQ ID NO: 1172 - RNA, 22 nt, Artificial Sequence
  Guide Sequence
uuccucagaugccuggaguuac

SEQ ID NO: 1173 - RNA, 22 nt, Artificial Sequence
  Guide Sequence
uucuuccucagaugccuggagu

SEQ ID NO: 1174 - RNA, 22 nt, Artificial Sequence
  Guide Sequence
uugacuuucuuccucagaugcc

SEQ ID NO: 1175 - RNA, 22 nt, Artificial Sequence
  Guide Sequence
uuucuuccucagaugccuggag

SEQ ID NO: 1176 - RNA, 20 nt, Artificial Sequence
  Guide Sequence
aacuccaggaaucugaggga

SEQ ID NO: 1177 - RNA, 20 nt, Artificial Sequence
  Guide Sequence
acaguaacuccaggaaucug

SEQ ID NO: 1178 - RNA, 20 nt, Artificial Sequence
  Guide Sequence
acgucuuuuacaguaacucc

SEQ ID NO: 1179 - RNA, 20 nt, Artificial Sequence
  Guide Sequence
acuccaggaaucugagggag

SEQ ID NO: 1180 - RNA, 20 nt, Artificial Sequence
  Guide Sequence
acuuucucccucagauuccu

SEQ ID NO: 1181 - RNA, 20 nt, Artificial Sequence
  Guide Sequence
agauuccuggaguuacugua

SEQ ID NO: 1182 - RNA, 20 nt, Artificial Sequence
  Guide Sequence
aggaaucugagggagaaagu

SEQ ID NO: 1183 - RNA, 20 nt, Artificial Sequence
  Guide Sequence
aguaacuccaggaaucugag

SEQ ID NO: 1184 - RNA, 20 nt, Artificial Sequence
  Guide Sequence
augcuugacuuucucccuca

SEQ ID NO: 1185 - RNA, 20 nt, Artificial Sequence
  Guide Sequence
auuccuggaguuacuguaaa

SEQ ID NO: 1186 - RNA, 20 nt, Artificial Sequence
  Guide Sequence
cagauuccuggaguuacugu

SEQ ID NO: 1187 - RNA, 20 nt, Artificial Sequence
  Guide Sequence
caggaaucugagggagaaag

SEQ ID NO: 1188 - RNA, 20 nt, Artificial Sequence
  Guide Sequence
caguaacuccaggaaucuga

SEQ ID NO: 1189 - RNA, 20 nt, Artificial Sequence
  Guide Sequence
ccaggaaucugagggagaaa

SEQ ID NO: 1190 - RNA, 20 nt, Artificial Sequence
  Guide Sequence
cccucagauuccuggaguua

SEQ ID NO: 1191 - RNA, 20 nt, Artificial Sequence
  Guide Sequence
ccucagauuccuggaguuac

SEQ ID NO: 1192 - RNA, 20 nt, Artificial Sequence
  Guide Sequence
cgucuuuuacaguaacucca

SEQ ID NO: 1193 - RNA, 20 nt, Artificial Sequence
  Guide Sequence
cucagauuccuggaguuacu

SEQ ID NO: 1194 - RNA, 20 nt, Artificial Sequence
  Guide Sequence
cuccaggaaucugagggaga

SEQ ID NO: 1195 - RNA, 20 nt, Artificial Sequence
  Guide Sequence
cucccucagauuccuggagu

SEQ ID NO: 1196 - RNA, 20 nt, Artificial Sequence
  Guide Sequence
cuugacuuucucccucagau

SEQ ID NO: 1197 - RNA, 20 nt, Artificial Sequence
  Guide Sequence
cuuucucccucagauuccug

SEQ ID NO: 1198 - RNA, 20 nt, Artificial Sequence
  Guide Sequence
cuuuuacaguaacuccagga

SEQ ID NO: 1199 - RNA, 20 nt, Artificial Sequence
  Guide Sequence
gaaucugagggagaaaguca

SEQ ID NO: 1200 - RNA, 20 nt, Artificial Sequence
  Guide Sequence
gacuuucucccucagauucc

SEQ ID NO: 1201 - RNA, 20 nt, Artificial Sequence
  Guide Sequence
gauuccuggaguuacuguaa

SEQ ID NO: 1202 - RNA, 20 nt, Artificial Sequence
  Guide Sequence
gcuugacuuucucccucaga

SEQ ID NO: 1203 - RNA, 20 nt, Artificial Sequence
  Guide Sequence
ggaaucugagggagaaaguc

SEQ ID NO: 1204 - RNA, 20 nt, Artificial Sequence
  Guide Sequence
guaacuccaggaaucugagg

SEQ ID NO: 1205 - RNA, 20 nt, Artificial Sequence
  Guide Sequence
gucuuuuacaguaacuccag

SEQ ID NO: 1206 - RNA, 20 nt, Artificial Sequence
  Guide Sequence
uaacuccaggaaucugaggg

SEQ ID NO: 1207 - RNA, 20 nt, Artificial Sequence
  Guide Sequence
uacaguaacuccaggaaucu

SEQ ID NO: 1208 - RNA, 20 nt, Artificial Sequence
  Guide Sequence
ucagauuccuggaguuacug

SEQ ID NO: 1209 - RNA, 20 nt, Artificial Sequence
  Guide Sequence
uccaggaaucugagggagaa

SEQ ID NO: 1210 - RNA, 20 nt, Artificial Sequence
  Guide Sequence
ucccucagauuccuggaguu

SEQ ID NO: 1211 - RNA, 20 nt, Artificial Sequence
  Guide Sequence
ucucccucagauuccuggag

SEQ ID NO: 1212 - RNA, 20 nt, Artificial Sequence
  Guide Sequence
ucuuuuacaguaacuccagg

SEQ ID NO: 1213 - RNA, 20 nt, Artificial Sequence
  Guide Sequence
ugacuuucucccucagauuc

SEQ ID NO: 1214 - RNA, 20 nt, Artificial Sequence
  Guide Sequence
ugcuugacuuucucccucag

SEQ ID NO: 1215 - RNA, 20 nt, Artificial Sequence
  Guide Sequence
uuacaguaacuccaggaauc

SEQ ID NO: 1216 - RNA, 20 nt, Artificial Sequence
  Guide Sequence
uuccuggaguuacuguaaaa

SEQ ID NO: 1217 - RNA, 20 nt, Artificial Sequence
  Guide Sequence
uucucccucagauuccugga

SEQ ID NO: 1218 - RNA, 20 nt, Artificial Sequence
  Guide Sequence
uugacuuucucccucagauu

SEQ ID NO: 1219 - RNA, 20 nt, Artificial Sequence
  Guide Sequence
uuuacaguaacuccaggaau

SEQ ID NO: 1220 - RNA, 20 nt, Artificial Sequence
  Guide Sequence
uuucucccucagauuccugg

SEQ ID NO: 1221 - RNA, 20 nt, Artificial Sequence
  Guide Sequence
uuuuacaguaacuccaggaa

SEQ ID NO: 1222 - RNA, 21 nt, Artificial Sequence
  Guide Sequence
aacuccaggaaucugagggag

SEQ ID NO: 1223 - RNA, 21 nt, Artificial Sequence
  Guide Sequence
acaguaacuccaggaaucuga

SEQ ID NO: 1224 - RNA, 21 nt, Artificial Sequence
  Guide Sequence
acgucuuuuacaguaacucca

SEQ ID NO: 1225 - RNA, 21 nt, Artificial Sequence
  Guide Sequence
acuccaggaaucugagggaga

SEQ ID NO: 1226 - RNA, 21 nt, Artificial Sequence
  Guide Sequence
acuuucucccucagauuccug

SEQ ID NO: 1227 - RNA, 21 nt, Artificial Sequence
  Guide Sequence
agauuccuggaguuacuguaa

SEQ ID NO: 1228 - RNA, 21 nt, Artificial Sequence
  Guide Sequence
aggaaucugagggagaaaguc

SEQ ID NO: 1229 - RNA, 21 nt, Artificial Sequence
  Guide Sequence
aguaacuccaggaaucugagg

SEQ ID NO: 1230 - RNA, 21 nt, Artificial Sequence
  Guide Sequence
augcuugacuuucucccucag

SEQ ID NO: 1231 - RNA, 21 nt, Artificial Sequence
  Guide Sequence
auuccuggaguuacuguaaaa

SEQ ID NO: 1232 - RNA, 21 nt, Artificial Sequence
  Guide Sequence
cacgucuuuuacaguaacucc

SEQ ID NO: 1233 - RNA, 21 nt, Artificial Sequence
  Guide Sequence
cagauuccuggaguuacugua

SEQ ID NO: 1234 - RNA, 21 nt, Artificial Sequence
  Guide Sequence
caggaaucugagggagaaagu

SEQ ID NO: 1235 - RNA, 21 nt, Artificial Sequence
  Guide Sequence
caguaacuccaggaaucugag

SEQ ID NO: 1236 - RNA, 21 nt, Artificial Sequence
  Guide Sequence
caugcuugacuuucucccuca

SEQ ID NO: 1237 - RNA, 21 nt, Artificial Sequence
  Guide Sequence
ccaggaaucugagggagaaag

SEQ ID NO: 1238 - RNA, 21 nt, Artificial Sequence
  Guide Sequence
cccucagauuccuggaguuac

SEQ ID NO: 1239 - RNA, 21 nt, Artificial Sequence
  Guide Sequence
ccucagauuccuggaguuacu

SEQ ID NO: 1240 - RNA, 21 nt, Artificial Sequence
  Guide Sequence
cgucuuuuacaguaacuccag

SEQ ID NO: 1241 - RNA, 21 nt, Artificial Sequence
  Guide Sequence
cucagauuccuggaguuacug

SEQ ID NO: 1242 - RNA, 21 nt, Artificial Sequence
  Guide Sequence
cuccaggaaucugagggagaa

SEQ ID NO: 1243 - RNA, 21 nt, Artificial Sequence
  Guide Sequence
cucccucagauuccuggaguu

SEQ ID NO: 1244 - RNA, 21 nt, Artificial Sequence
  Guide Sequence
cuugacuuucucccucagauu

SEQ ID NO: 1245 - RNA, 21 nt, Artificial Sequence
  Guide Sequence
cuuucucccucagauuccugg

SEQ ID NO: 1246 - RNA, 21 nt, Artificial Sequence
  Guide Sequence
cuuuuacaguaacuccaggaa

SEQ ID NO: 1247 - RNA, 21 nt, Artificial Sequence
  Guide Sequence
gaaucugagggagaaagucaa

SEQ ID NO: 1248 - RNA, 21 nt, Artificial Sequence
  Guide Sequence
gacuuucucccucagauuccu

SEQ ID NO: 1249 - RNA, 21 nt, Artificial Sequence
  Guide Sequence
gauuccuggaguuacuguaaa

SEQ ID NO: 1250 - RNA, 21 nt, Artificial Sequence
  Guide Sequence
gcuugacuuucucccucagau

SEQ ID NO: 1251 - RNA, 21 nt, Artificial Sequence
  Guide Sequence
ggaaucugagggagaaaguca

SEQ ID NO: 1252 - RNA, 21 nt, Artificial Sequence
  Guide Sequence
guaacuccaggaaucugaggg

SEQ ID NO: 1253 - RNA, 21 nt, Artificial Sequence
  Guide Sequence
gucuuuuacaguaacuccagg

SEQ ID NO: 1254 - RNA, 21 nt, Artificial Sequence
  Guide Sequence
uaacuccaggaaucugaggga

SEQ ID NO: 1255 - RNA, 21 nt, Artificial Sequence
  Guide Sequence
uacaguaacuccaggaaucug

SEQ ID NO: 1256 - RNA, 21 nt, Artificial Sequence
  Guide Sequence
ucagauuccuggaguuacugu

SEQ ID NO: 1257 - RNA, 21 nt, Artificial Sequence
  Guide Sequence
uccaggaaucugagggagaaa

SEQ ID NO: 1258 - RNA, 21 nt, Artificial Sequence
  Guide Sequence
ucccucagauuccuggaguua

SEQ ID NO: 1259 - RNA, 21 nt, Artificial Sequence
  Guide Sequence
ucucccucagauuccuggagu

SEQ ID NO: 1260 - RNA, 21 nt, Artificial Sequence
  Guide Sequence
ucuuuuacaguaacuccagga

SEQ ID NO: 1261 - RNA, 21 nt, Artificial Sequence
  Guide Sequence
ugacuuucucccucagauucc

SEQ ID NO: 1262 - RNA, 21 nt, Artificial Sequence
  Guide Sequence
ugcuugacuuucucccucaga

SEQ ID NO: 1263 - RNA, 21 nt, Artificial Sequence
  Guide Sequence
uuacaguaacuccaggaaucu

SEQ ID NO: 1264 - RNA, 21 nt, Artificial Sequence
  Guide Sequence
uuccuggaguuacuguaaaag

SEQ ID NO: 1265 - RNA, 21 nt, Artificial Sequence
  Guide Sequence
uucucccucagauuccuggag

SEQ ID NO: 1266 - RNA, 21 nt, Artificial Sequence
  Guide Sequence
uugacuuucucccucagauuc

SEQ ID NO: 1267 - RNA, 21 nt, Artificial Sequence
  Guide Sequence
uuuacaguaacuccaggaauc

SEQ ID NO: 1268 - RNA, 21 nt, Artificial Sequence
  Guide Sequence
uuucucccucagauuccugga

SEQ ID NO: 1269 - RNA, 21 nt, Artificial Sequence
  Guide Sequence
uuuuacaguaacuccaggaau

SEQ ID NO: 1270 - RNA, 22 nt, Artificial Sequence
  Guide Sequence
aacuccaggaaucugagggaga

SEQ ID NO: 1271 - RNA, 22 nt, Artificial Sequence
  Guide Sequence
acaguaacuccaggaaucugag

SEQ ID NO: 1272 - RNA, 22 nt, Artificial Sequence
  Guide Sequence
acaugcuugacuuucucccuca

SEQ ID NO: 1273 - RNA, 22 nt, Artificial Sequence
  Guide Sequence
acgucuuuuacaguaacuccag

SEQ ID NO: 1274 - RNA, 22 nt, Artificial Sequence
  Guide Sequence
acuccaggaaucugagggagaa

SEQ ID NO: 1275 - RNA, 22 nt, Artificial Sequence
  Guide Sequence
acuuucucccucagauuccugg

SEQ ID NO: 1276 - RNA, 22 nt, Artificial Sequence
  Guide Sequence
agauuccuggaguuacuguaaa

SEQ ID NO: 1277 - RNA, 22 nt, Artificial Sequence
  Guide Sequence
aggaaucugagggagaaaguca

SEQ ID NO: 1278 - RNA, 22 nt, Artificial Sequence
  Guide Sequence
aguaacuccaggaaucugaggg

SEQ ID NO: 1279 - RNA, 22 nt, Artificial Sequence
  Guide Sequence
augcuugacuuucucccucaga

SEQ ID NO: 1280 - RNA, 22 nt, Artificial Sequence
  Guide Sequence
auuccuggaguuacuguaaaag

SEQ ID NO: 1281 - RNA, 22 nt, Artificial Sequence
  Guide Sequence
cacgucuuuuacaguaacucca

SEQ ID NO: 1282 - RNA, 22 nt, Artificial Sequence
  Guide Sequence
cagauuccuggaguuacuguaa

SEQ ID NO: 1283 - RNA, 22 nt, Artificial Sequence
  Guide Sequence
caggaaucugagggagaaaguc

SEQ ID NO: 1284 - RNA, 22 nt, Artificial Sequence
  Guide Sequence
caguaacuccaggaaucugagg

SEQ ID NO: 1285 - RNA, 22 nt, Artificial Sequence
  Guide Sequence
caugcuugacuuucucccucag

SEQ ID NO: 1286 - RNA, 22 nt, Artificial Sequence
  Guide Sequence
ccaggaaucugagggagaaagu

SEQ ID NO: 1287 - RNA, 22 nt, Artificial Sequence
  Guide Sequence
cccucagauuccuggaguuacu

SEQ ID NO: 1288 - RNA, 22 nt, Artificial Sequence
  Guide Sequence
ccucagauuccuggaguuacug

SEQ ID NO: 1289 - RNA, 22 nt, Artificial Sequence
  Guide Sequence
cgucuuuuacaguaacuccagg

SEQ ID NO: 1290 - RNA, 22 nt, Artificial Sequence
  Guide Sequence
cucagauuccuggaguuacugu

SEQ ID NO: 1291 - RNA, 22 nt, Artificial Sequence
  Guide Sequence
cuccaggaaucugagggagaaa

SEQ ID NO: 1292 - RNA, 22 nt, Artificial Sequence
  Guide Sequence
cucccucagauuccuggaguua

SEQ ID NO: 1293 - RNA, 22 nt, Artificial Sequence
  Guide Sequence
cuugacuuucucccucagauuc

SEQ ID NO: 1294 - RNA, 22 nt, Artificial Sequence
  Guide Sequence
cuuucucccucagauuccugga

SEQ ID NO: 1295 - RNA, 22 nt, Artificial Sequence
  Guide Sequence
cuuuuacaguaacuccaggaau

SEQ ID NO: 1296 - RNA, 22 nt, Artificial Sequence
  Guide Sequence
gaaucugagggagaaagucaag

SEQ ID NO: 1297 - RNA, 22 nt, Artificial Sequence
  Guide Sequence
gacuuucucccucagauuccug

SEQ ID NO: 1298 - RNA, 22 nt, Artificial Sequence
  Guide Sequence
gauuccuggaguuacuguaaaa

SEQ ID NO: 1299 - RNA, 22 nt, Artificial Sequence
  Guide Sequence
gcuugacuuucucccucagauu

SEQ ID NO: 1300 - RNA, 22 nt, Artificial Sequence
  Guide Sequence
ggaaucugagggagaaagucaa

SEQ ID NO: 1301 - RNA, 22 nt, Artificial Sequence
  Guide Sequence
guaacuccaggaaucugaggga

SEQ ID NO: 1302 - RNA, 22 nt, Artificial Sequence
  Guide Sequence
gucuuuuacaguaacuccagga

SEQ ID NO: 1303 - RNA, 22 nt, Artificial Sequence
  Guide Sequence
uaacuccaggaaucugagggag

SEQ ID NO: 1304 - RNA, 22 nt, Artificial Sequence
  Guide Sequence
uacaguaacuccaggaaucuga

SEQ ID NO: 1305 - RNA, 22 nt, Artificial Sequence
  Guide Sequence
ucacgucuuuuacaguaacucc

SEQ ID NO: 1306 - RNA, 22 nt, Artificial Sequence
  Guide Sequence
ucagauuccuggaguuacugua

SEQ ID NO: 1307 - RNA, 22 nt, Artificial Sequence
  Guide Sequence
uccaggaaucugagggagaaag

SEQ ID NO: 1308 - RNA, 22 nt, Artificial Sequence
  Guide Sequence
ucccucagauuccuggaguuac

SEQ ID NO: 1309 - RNA, 22 nt, Artificial Sequence
  Guide Sequence
ucucccucagauuccuggaguu

SEQ ID NO: 1310 - RNA, 22 nt, Artificial Sequence
  Guide Sequence
ucuuuuacaguaacuccaggaa

SEQ ID NO: 1311 - RNA, 22 nt, Artificial Sequence
  Guide Sequence
ugacuuucucccucagauuccu

SEQ ID NO: 1312 - RNA, 22 nt, Artificial Sequence
  Guide Sequence
ugcuugacuuucucccucagau

SEQ ID NO: 1313 - RNA, 22 nt, Artificial Sequence
  Guide Sequence
uuacaguaacuccaggaaucug

SEQ ID NO: 1314 - RNA, 22 nt, Artificial Sequence
  Guide Sequence
uuccuggaguuacuguaaaaga

SEQ ID NO: 1315 - RNA, 22 nt, Artificial Sequence
  Guide Sequence
uucucccucagauuccuggagu

SEQ ID NO: 1316 - RNA, 22 nt, Artificial Sequence
  Guide Sequence
uugacuuucucccucagauucc

SEQ ID NO: 1317 - RNA, 22 nt, Artificial Sequence
  Guide Sequence
uuuacaguaacuccaggaaucu

SEQ ID NO: 1318 - RNA, 22 nt, Artificial Sequence
  Guide Sequence
uuucucccucagauuccuggag

SEQ ID NO: 1319 - RNA, 22 nt, Artificial Sequence
  Guide Sequence
uuuuacaguaacuccaggaauc

SEQ ID NO: 1320 - RNA, 20 nt, Artificial Sequence
  Guide Sequence
aaccagcaggaguucuucag

SEQ ID NO: 1321 - RNA, 20 nt, Artificial Sequence
  Guide Sequence
aagaacuccugcugguucac

SEQ ID NO: 1322 - RNA, 20 nt, Artificial Sequence
  Guide Sequence
aagacgugaaccagcaggag

SEQ ID NO: 1323 - RNA, 20 nt, Artificial Sequence
  Guide Sequence
aaggcugccagagcucugaa

SEQ ID NO: 1324 - RNA, 20 nt, Artificial Sequence
  Guide Sequence
accagcaggaguucuucaga

SEQ ID NO: 1325 - RNA, 20 nt, Artificial Sequence
  Guide Sequence
acgugaaccagcaggaguuc

SEQ ID NO: 1326 - RNA, 20 nt, Artificial Sequence
  Guide Sequence
agacgugaaccagcaggagu

SEQ ID NO: 1327 - RNA, 20 nt, Artificial Sequence
  Guide Sequence
agagcucugaagaacuccug

SEQ ID NO: 1328 - RNA, 20 nt, Artificial Sequence
  Guide Sequence
agcaggaguucuucagagcu

SEQ ID NO: 1329 - RNA, 20 nt, Artificial Sequence
  Guide Sequence
agcucugaagaacuccugcu

SEQ ID NO: 1330 - RNA, 20 nt, Artificial Sequence
  Guide Sequence
aggaaggcugccagagcucu

SEQ ID NO: 1331 - RNA, 20 nt, Artificial Sequence
  Guide Sequence
aggaguucuucagagcucug

SEQ ID NO: 1332 - RNA, 20 nt, Artificial Sequence
  Guide Sequence
aggcugccagagcucugaag

SEQ ID NO: 1333 - RNA, 20 nt, Artificial Sequence
  Guide Sequence
aguucuucagagcucuggca

SEQ ID NO: 1334 - RNA, 20 nt, Artificial Sequence
  Guide Sequence
cagagcucugaagaacuccu

SEQ ID NO: 1335 - RNA, 20 nt, Artificial Sequence
  Guide Sequence
cagcaggaguucuucagagc

SEQ ID NO: 1336 - RNA, 20 nt, Artificial Sequence
  Guide Sequence
caggaguucuucagagcucu

SEQ ID NO: 1337 - RNA, 20 nt, Artificial Sequence
  Guide Sequence
ccagagcucugaagaacucc

SEQ ID NO: 1338 - RNA, 20 nt, Artificial Sequence
  Guide Sequence
ccagcaggaguucuucagag

SEQ ID NO: 1339 - RNA, 20 nt, Artificial Sequence
  Guide Sequence
cgugaaccagcaggaguucu

SEQ ID NO: 1340 - RNA, 20 nt, Artificial Sequence
  Guide Sequence
cucugaagaacuccugcugg

SEQ ID NO: 1341 - RNA, 20 nt, Artificial Sequence
  Guide Sequence
cugaagaacuccugcugguu

SEQ ID NO: 1342 - RNA, 20 nt, Artificial Sequence
  Guide Sequence
cugccagagcucugaagaac

SEQ ID NO: 1343 - RNA, 20 nt, Artificial Sequence
  Guide Sequence
cuucagagcucuggcagccu

SEQ ID NO: 1344 - RNA, 20 nt, Artificial Sequence
  Guide Sequence
gaaccagcaggaguucuuca

SEQ ID NO: 1345 - RNA, 20 nt, Artificial Sequence
  Guide Sequence
gaagaacuccugcugguuca

SEQ ID NO: 1346 - RNA, 20 nt, Artificial Sequence
  Guide Sequence
gaaggcugccagagcucuga

SEQ ID NO: 1347 - RNA, 20 nt, Artificial Sequence
  Guide Sequence
gacgugaaccagcaggaguu

SEQ ID NO: 1348 - RNA, 20 nt, Artificial Sequence
  Guide Sequence
gagcucugaagaacuccugc

SEQ ID NO: 1349 - RNA, 20 nt, Artificial Sequence
  Guide Sequence
gaggaaggcugccagagcuc

SEQ ID NO: 1350 - RNA, 20 nt, Artificial Sequence
  Guide Sequence
gaguucuucagagcucuggc

SEQ ID NO: 1351 - RNA, 20 nt, Artificial Sequence
  Guide Sequence
gcaggaguucuucagagcuc

SEQ ID NO: 1352 - RNA, 20 nt, Artificial Sequence
  Guide Sequence
gccagagcucugaagaacuc

SEQ ID NO: 1353 - RNA, 20 nt, Artificial Sequence
  Guide Sequence
gcucugaagaacuccugcug

SEQ ID NO: 1354 - RNA, 20 nt, Artificial Sequence
  Guide Sequence
gcugccagagcucugaagaa

SEQ ID NO: 1355 - RNA, 20 nt, Artificial Sequence
  Guide Sequence
ggaaggcugccagagcucug

SEQ ID NO: 1356 - RNA, 20 nt, Artificial Sequence
  Guide Sequence
ggaguucuucagagcucugg

SEQ ID NO: 1357 - RNA, 20 nt, Artificial Sequence
  Guide Sequence
ggcugccagagcucugaaga

SEQ ID NO: 1358 - RNA, 20 nt, Artificial Sequence
  Guide Sequence
gugaaccagcaggaguucuu

SEQ ID NO: 1359 - RNA, 20 nt, Artificial Sequence
  Guide Sequence
guucuucagagcucuggcag

SEQ ID NO: 1360 - RNA, 20 nt, Artificial Sequence
  Guide Sequence
ucugaagaacuccugcuggu

SEQ ID NO: 1361 - RNA, 20 nt, Artificial Sequence
  Guide Sequence
ucuucagagcucuggcagcc

SEQ ID NO: 1362 - RNA, 20 nt, Artificial Sequence
  Guide Sequence
ugaaccagcaggaguucuuc

SEQ ID NO: 1363 - RNA, 20 nt, Artificial Sequence
  Guide Sequence
ugaagaacuccugcugguuc

SEQ ID NO: 1364 - RNA, 20 nt, Artificial Sequence
  Guide Sequence
ugccagagcucugaagaacu

SEQ ID NO: 1365 - RNA, 20 nt, Artificial Sequence
  Guide Sequence
uucuucagagcucuggcagc

SEQ ID NO: 1366 - RNA, 21 nt, Artificial Sequence
  Guide Sequence
aaagacgugaaccagcaggag

SEQ ID NO: 1367 - RNA, 21 nt, Artificial Sequence
  Guide Sequence
aaccagcaggaguucuucaga

SEQ ID NO: 1368 - RNA, 21 nt, Artificial Sequence
  Guide Sequence
aagaacuccugcugguucacg

SEQ ID NO: 1369 - RNA, 21 nt, Artificial Sequence
  Guide Sequence
aagacgugaaccagcaggagu

SEQ ID NO: 1370 - RNA, 21 nt, Artificial Sequence
  Guide Sequence
aaggcugccagagcucugaag

SEQ ID NO: 1371 - RNA, 21 nt, Artificial Sequence
  Guide Sequence
accagcaggaguucuucagag

SEQ ID NO: 1372 - RNA, 21 nt, Artificial Sequence
  Guide Sequence
acgugaaccagcaggaguucu

SEQ ID NO: 1373 - RNA, 21 nt, Artificial Sequence
  Guide Sequence
agacgugaaccagcaggaguu

SEQ ID NO: 1374 - RNA, 21 nt, Artificial Sequence
  Guide Sequence
agagcucugaagaacuccugc

SEQ ID NO: 1375 - RNA, 21 nt, Artificial Sequence
  Guide Sequence
agcaggaguucuucagagcuc

SEQ ID NO: 1376 - RNA, 21 nt, Artificial Sequence
  Guide Sequence
agcucugaagaacuccugcug

SEQ ID NO: 1377 - RNA, 21 nt, Artificial Sequence
  Guide Sequence
aggaaggcugccagagcucug

SEQ ID NO: 1378 - RNA, 21 nt, Artificial Sequence
  Guide Sequence
aggaguucuucagagcucugg

SEQ ID NO: 1379 - RNA, 21 nt, Artificial Sequence
  Guide Sequence
aggcugccagagcucugaaga

SEQ ID NO: 1380 - RNA, 21 nt, Artificial Sequence
  Guide Sequence
aguucuucagagcucuggcag

SEQ ID NO: 1381 - RNA, 21 nt, Artificial Sequence
  Guide Sequence
cagagcucugaagaacuccug

SEQ ID NO: 1382 - RNA, 21 nt, Artificial Sequence
  Guide Sequence
cagcaggaguucuucagagcu

SEQ ID NO: 1383 - RNA, 21 nt, Artificial Sequence
  Guide Sequence
caggaguucuucagagcucug

SEQ ID NO: 1384 - RNA, 21 nt, Artificial Sequence
  Guide Sequence
ccagagcucugaagaacuccu

SEQ ID NO: 1385 - RNA, 21 nt, Artificial Sequence
  Guide Sequence
ccagcaggaguucuucagagc

SEQ ID NO: 1386 - RNA, 21 nt, Artificial Sequence
  Guide Sequence
cgugaaccagcaggaguucuu

SEQ ID NO: 1387 - RNA, 21 nt, Artificial Sequence
  Guide Sequence
cucugaagaacuccugcuggu

SEQ ID NO: 1388 - RNA, 21 nt, Artificial Sequence
  Guide Sequence
cugaagaacuccugcugguuc

SEQ ID NO: 1389 - RNA, 21 nt, Artificial Sequence
  Guide Sequence
cugccagagcucugaagaacu

SEQ ID NO: 1390 - RNA, 21 nt, Artificial Sequence
  Guide Sequence
cuucagagcucuggcagccuu

SEQ ID NO: 1391 - RNA, 21 nt, Artificial Sequence
  Guide Sequence
gaaccagcaggaguucuucag

SEQ ID NO: 1392 - RNA, 21 nt, Artificial Sequence
  Guide Sequence
gaagaacuccugcugguucac

SEQ ID NO: 1393 - RNA, 21 nt, Artificial Sequence
  Guide Sequence
gaaggcugccagagcucugaa

SEQ ID NO: 1394 - RNA, 21 nt, Artificial Sequence
  Guide Sequence
gacgugaaccagcaggaguuc

SEQ ID NO: 1395 - RNA, 21 nt, Artificial Sequence
  Guide Sequence
gagcucugaagaacuccugcu

SEQ ID NO: 1396 - RNA, 21 nt, Artificial Sequence
  Guide Sequence
gaggaaggcugccagagcucu

SEQ ID NO: 1397 - RNA, 21 nt, Artificial Sequence
  Guide Sequence
gaguucuucagagcucuggca

SEQ ID NO: 1398 - RNA, 21 nt, Artificial Sequence
  Guide Sequence
gcaggaguucuucagagcucu

SEQ ID NO: 1399 - RNA, 21 nt, Artificial Sequence
  Guide Sequence
gccagagcucugaagaacucc

SEQ ID NO: 1400 - RNA, 21 nt, Artificial Sequence
  Guide Sequence
gcucugaagaacuccugcugg

SEQ ID NO: 1401 - RNA, 21 nt, Artificial Sequence
  Guide Sequence
gcugccagagcucugaagaac

SEQ ID NO: 1402 - RNA, 21 nt, Artificial Sequence
  Guide Sequence
ggaaggcugccagagcucuga

SEQ ID NO: 1403 - RNA, 21 nt, Artificial Sequence
  Guide Sequence
ggaguucuucagagcucuggc

SEQ ID NO: 1404 - RNA, 21 nt, Artificial Sequence
  Guide Sequence
ggcugccagagcucugaagaa

SEQ ID NO: 1405 - RNA, 21 nt, Artificial Sequence
  Guide Sequence
gugaaccagcaggaguucuuc

SEQ ID NO: 1406 - RNA, 21 nt, Artificial Sequence
  Guide Sequence
guucuucagagcucuggcagc

SEQ ID NO: 1407 - RNA, 21 nt, Artificial Sequence
  Guide Sequence
ucugaagaacuccugcugguu

SEQ ID NO: 1408 - RNA, 21 nt, Artificial Sequence
  Guide Sequence
ucuucagagcucuggcagccu

SEQ ID NO: 1409 - RNA, 21 nt, Artificial Sequence
  Guide Sequence
ugaaccagcaggaguucuuca

SEQ ID NO: 1410 - RNA, 21 nt, Artificial Sequence
  Guide Sequence
ugaagaacuccugcugguuca

SEQ ID NO: 1411 - RNA, 21 nt, Artificial Sequence
  Guide Sequence
ugaggaaggcugccagagcuc

SEQ ID NO: 1412 - RNA, 21 nt, Artificial Sequence
  Guide Sequence
ugccagagcucugaagaacuc

SEQ ID NO: 1413 - RNA, 21 nt, Artificial Sequence
  Guide Sequence
uucuucagagcucuggcagcc

SEQ ID NO: 1414 - RNA, 22 nt, Artificial Sequence
  Guide Sequence
aaaagacgugaaccagcaggag

SEQ ID NO: 1415 - RNA, 22 nt, Artificial Sequence
  Guide Sequence
aaagacgugaaccagcaggagu

SEQ ID NO: 1416 - RNA, 22 nt, Artificial Sequence
  Guide Sequence
aaccagcaggaguucuucagag

SEQ ID NO: 1417 - RNA, 22 nt, Artificial Sequence
  Guide Sequence
aagaacuccugcugguucacgu

SEQ ID NO: 1418 - RNA, 22 nt, Artificial Sequence
  Guide Sequence
aagacgugaaccagcaggaguu

SEQ ID NO: 1419 - RNA, 22 nt, Artificial Sequence
  Guide Sequence
aaggcugccagagcucugaaga

SEQ ID NO: 1420 - RNA, 22 nt, Artificial Sequence
  Guide Sequence
accagcaggaguucuucagagc

SEQ ID NO: 1421 - RNA, 22 nt, Artificial Sequence
  Guide Sequence
acgugaaccagcaggaguucuu

SEQ ID NO: 1422 - RNA, 22 nt, Artificial Sequence
  Guide Sequence
agacgugaaccagcaggaguuc

SEQ ID NO: 1423 - RNA, 22 nt, Artificial Sequence
  Guide Sequence
agagcucugaagaacuccugcu

SEQ ID NO: 1424 - RNA, 22 nt, Artificial Sequence
  Guide Sequence
agcaggaguucuucagagcucu

SEQ ID NO: 1425 - RNA, 22 nt, Artificial Sequence
  Guide Sequence
agcucugaagaacuccugcugg

SEQ ID NO: 1426 - RNA, 22 nt, Artificial Sequence
  Guide Sequence
aggaaggcugccagagcucuga

SEQ ID NO: 1427 - RNA, 22 nt, Artificial Sequence
  Guide Sequence
aggaguucuucagagcucuggc

SEQ ID NO: 1428 - RNA, 22 nt, Artificial Sequence
  Guide Sequence
aggcugccagagcucugaagaa

SEQ ID NO: 1429 - RNA, 22 nt, Artificial Sequence
  Guide Sequence
aguucuucagagcucuggcagc

SEQ ID NO: 1430 - RNA, 22 nt, Artificial Sequence
  Guide Sequence
cagagcucugaagaacuccugc

SEQ ID NO: 1431 - RNA, 22 nt, Artificial Sequence
  Guide Sequence
cagcaggaguucuucagagcuc

SEQ ID NO: 1432 - RNA, 22 nt, Artificial Sequence
  Guide Sequence
caggaguucuucagagcucugg

SEQ ID NO: 1433 - RNA, 22 nt, Artificial Sequence
  Guide Sequence
ccagagcucugaagaacuccug

SEQ ID NO: 1434 - RNA, 22 nt, Artificial Sequence
  Guide Sequence
ccagcaggaguucuucagagcu

SEQ ID NO: 1435 - RNA, 22 nt, Artificial Sequence
  Guide Sequence
cgugaaccagcaggaguucuuc

SEQ ID NO: 1436 - RNA, 22 nt, Artificial Sequence
  Guide Sequence
cucugaagaacuccugcugguu

SEQ ID NO: 1437 - RNA, 22 nt, Artificial Sequence
  Guide Sequence
cugaagaacuccugcugguuca

SEQ ID NO: 1438 - RNA, 22 nt, Artificial Sequence
  Guide Sequence
cugccagagcucugaagaacuc

SEQ ID NO: 1439 - RNA, 22 nt, Artificial Sequence
  Guide Sequence
cuucagagcucuggcagccuuc

SEQ ID NO: 1440 - RNA, 22 nt, Artificial Sequence
  Guide Sequence
gaaccagcaggaguucuucaga

SEQ ID NO: 1441 - RNA, 22 nt, Artificial Sequence
  Guide Sequence
gaagaacuccugcugguucacg

SEQ ID NO: 1442 - RNA, 22 nt, Artificial Sequence
  Guide Sequence
gaaggcugccagagcucugaag

SEQ ID NO: 1443 - RNA, 22 nt, Artificial Sequence
  Guide Sequence
gacgugaaccagcaggaguucu

SEQ ID NO: 1444 - RNA, 22 nt, Artificial Sequence
  Guide Sequence
gagcucugaagaacuccugcug

SEQ ID NO: 1445 - RNA, 22 nt, Artificial Sequence
  Guide Sequence
gaggaaggcugccagagcucug

SEQ ID NO: 1446 - RNA, 22 nt, Artificial Sequence
  Guide Sequence
gaguucuucagagcucuggcag

SEQ ID NO: 1447 - RNA, 22 nt, Artificial Sequence
  Guide Sequence
gcaggaguucuucagagcucug

SEQ ID NO: 1448 - RNA, 22 nt, Artificial Sequence
  Guide Sequence
gccagagcucugaagaacuccu

SEQ ID NO: 1449 - RNA, 22 nt, Artificial Sequence
  Guide Sequence
gcucugaagaacuccugcuggu

SEQ ID NO: 1450 - RNA, 22 nt, Artificial Sequence
  Guide Sequence
gcugccagagcucugaagaacu

SEQ ID NO: 1451 - RNA, 22 nt, Artificial Sequence
  Guide Sequence
ggaaggcugccagagcucugaa

SEQ ID NO: 1452 - RNA, 22 nt, Artificial Sequence
  Guide Sequence
ggaguucuucagagcucuggca

SEQ ID NO: 1453 - RNA, 22 nt, Artificial Sequence
  Guide Sequence
ggcugccagagcucugaagaac

SEQ ID NO: 1454 - RNA, 22 nt, Artificial Sequence
  Guide Sequence
gugaaccagcaggaguucuuca

SEQ ID NO: 1455 - RNA, 22 nt, Artificial Sequence
  Guide Sequence
guucuucagagcucuggcagcc

SEQ ID NO: 1456 - RNA, 22 nt, Artificial Sequence
  Guide Sequence
ucugaagaacuccugcugguuc

SEQ ID NO: 1457 - RNA, 22 nt, Artificial Sequence
  Guide Sequence
ucuucagagcucuggcagccuu

SEQ ID NO: 1458 - RNA, 22 nt, Artificial Sequence
  Guide Sequence
ugaaccagcaggaguucuucag

SEQ ID NO: 1459 - RNA, 22 nt, Artificial Sequence
  Guide Sequence
ugaagaacuccugcugguucac

SEQ ID NO: 1460 - RNA, 22 nt, Artificial Sequence
  Guide Sequence
ugaggaaggcugccagagcucu

SEQ ID NO: 1461 - RNA, 22 nt, Artificial Sequence
  Guide Sequence
ugccagagcucugaagaacucc

SEQ ID NO: 1462 - RNA, 22 nt, Artificial Sequence
  Guide Sequence
uucuucagagcucuggcagccu

SEQ ID NO: 1463 - RNA, 22 nt, Artificial Sequence
  Guide Sequence
uugaggaaggcugccagagcuc

SEQ ID NO: 1464 - RNA, 20 nt, Artificial Sequence
  Guide Sequence
aaccagcaggaguucgucag

SEQ ID NO: 1465 - RNA, 20 nt, Artificial Sequence
  Guide Sequence
aaggcugccagaggucugac

SEQ ID NO: 1466 - RNA, 20 nt, Artificial Sequence
  Guide Sequence
accagcaggaguucgucaga

SEQ ID NO: 1467 - RNA, 20 nt, Artificial Sequence
  Guide Sequence
accucuggcagccuuccuca

SEQ ID NO: 1468 - RNA, 20 nt, Artificial Sequence
  Guide Sequence
agaccucuggcagccuuccu

SEQ ID NO: 1469 - RNA, 20 nt, Artificial Sequence
  Guide Sequence
agaggucugacgaacuccug

SEQ ID NO: 1470 - RNA, 20 nt, Artificial Sequence
  Guide Sequence
agcaggaguucgucagaccu

SEQ ID NO: 1471 - RNA, 20 nt, Artificial Sequence
  Guide Sequence
aggaaggcugccagaggucu

SEQ ID NO: 1472 - RNA, 20 nt, Artificial Sequence
  Guide Sequence
aggaguucgucagaccucug

SEQ ID NO: 1473 - RNA, 20 nt, Artificial Sequence
  Guide Sequence
aggcugccagaggucugacg

SEQ ID NO: 1474 - RNA, 20 nt, Artificial Sequence
  Guide Sequence
aggucugacgaacuccugcu

SEQ ID NO: 1475 - RNA, 20 nt, Artificial Sequence
  Guide Sequence
aguucgucagaccucuggca

SEQ ID NO: 1476 - RNA, 20 nt, Artificial Sequence
  Guide Sequence
cagaccucuggcagccuucc

SEQ ID NO: 1477 - RNA, 20 nt, Artificial Sequence
  Guide Sequence
cagaggucugacgaacuccu

SEQ ID NO: 1478 - RNA, 20 nt, Artificial Sequence
  Guide Sequence
cagcaggaguucgucagacc

SEQ ID NO: 1479 - RNA, 20 nt, Artificial Sequence
  Guide Sequence
caggaguucgucagaccucu

SEQ ID NO: 1480 - RNA, 20 nt, Artificial Sequence
  Guide Sequence
ccagaggucugacgaacucc

SEQ ID NO: 1481 - RNA, 20 nt, Artificial Sequence
  Guide Sequence
ccagcaggaguucgucagac

SEQ ID NO: 1482 - RNA, 20 nt, Artificial Sequence
  Guide Sequence
cgucagaccucuggcagccu

SEQ ID NO: 1483 - RNA, 20 nt, Artificial Sequence
  Guide Sequence
cugccagaggucugacgaac

SEQ ID NO: 1484 - RNA, 20 nt, Artificial Sequence
  Guide Sequence
cuuuuugaggaaggcugcca

SEQ ID NO: 1485 - RNA, 20 nt, Artificial Sequence
  Guide Sequence
gaaccagcaggaguucguca

SEQ ID NO: 1486 - RNA, 20 nt, Artificial Sequence
  Guide Sequence
gaaggcugccagaggucuga

SEQ ID NO: 1487 - RNA, 20 nt, Artificial Sequence
  Guide Sequence
gaccucuggcagccuuccuc

SEQ ID NO: 1488 - RNA, 20 nt, Artificial Sequence
  Guide Sequence
gaggaaggcugccagagguc

SEQ ID NO: 1489 - RNA, 20 nt, Artificial Sequence
  Guide Sequence
gaggucugacgaacuccugc

SEQ ID NO: 1490 - RNA, 20 nt, Artificial Sequence
  Guide Sequence
gaguucgucagaccucuggc

SEQ ID NO: 1491 - RNA, 20 nt, Artificial Sequence
  Guide Sequence
gcaggaguucgucagaccuc

SEQ ID NO: 1492 - RNA, 20 nt, Artificial Sequence
  Guide Sequence
gccagaggucugacgaacuc

SEQ ID NO: 1493 - RNA, 20 nt, Artificial Sequence
  Guide Sequence
gcugccagaggucugacgaa

SEQ ID NO: 1494 - RNA, 20 nt, Artificial Sequence
  Guide Sequence
ggaaggcugccagaggucug

SEQ ID NO: 1495 - RNA, 20 nt, Artificial Sequence
  Guide Sequence
ggaguucgucagaccucugg

SEQ ID NO: 1496 - RNA, 20 nt, Artificial Sequence
  Guide Sequence
ggcugccagaggucugacga

SEQ ID NO: 1497 - RNA, 20 nt, Artificial Sequence
  Guide Sequence
ggucugacgaacuccugcug

SEQ ID NO: 1498 - RNA, 20 nt, Artificial Sequence
  Guide Sequence
gucagaccucuggcagccuu

SEQ ID NO: 1499 - RNA, 20 nt, Artificial Sequence
  Guide Sequence
guucgucagaccucuggcag

SEQ ID NO: 1500 - RNA, 20 nt, Artificial Sequence
  Guide Sequence
ucagaccucuggcagccuuc

SEQ ID NO: 1501 - RNA, 20 nt, Artificial Sequence
  Guide Sequence
ucgucagaccucuggcagcc

SEQ ID NO: 1502 - RNA, 20 nt, Artificial Sequence
  Guide Sequence
ugaaccagcaggaguucguc

SEQ ID NO: 1503 - RNA, 20 nt, Artificial Sequence
  Guide Sequence
ugaggaaggcugccagaggu

SEQ ID NO: 1504 - RNA, 20 nt, Artificial Sequence
  Guide Sequence
ugccagaggucugacgaacu

SEQ ID NO: 1505 - RNA, 20 nt, Artificial Sequence
  Guide Sequence
uucgucagaccucuggcagc

SEQ ID NO: 1506 - RNA, 20 nt, Artificial Sequence
  Guide Sequence
uugaggaaggcugccagagg

SEQ ID NO: 1507 - RNA, 20 nt, Artificial Sequence
  Guide Sequence
uuugaggaaggcugccagag

SEQ ID NO: 1508 - RNA, 20 nt, Artificial Sequence
  Guide Sequence
uuuugaggaaggcugccaga

SEQ ID NO: 1509 - RNA, 20 nt, Artificial Sequence
  Guide Sequence
uuuuugaggaaggcugccag

SEQ ID NO: 1510 - RNA, 21 nt, Artificial Sequence
  Guide Sequence
aaccagcaggaguucgucaga

SEQ ID NO: 1511 - RNA, 21 nt, Artificial Sequence
  Guide Sequence
aaggcugccagaggucugacg

SEQ ID NO: 1512 - RNA, 21 nt, Artificial Sequence
  Guide Sequence
accagcaggaguucgucagac

SEQ ID NO: 1513 - RNA, 21 nt, Artificial Sequence
  Guide Sequence
accucuggcagccuuccucaa

SEQ ID NO: 1514 - RNA, 21 nt, Artificial Sequence
  Guide Sequence
acuuuuugaggaaggcugcca

SEQ ID NO: 1515 - RNA, 21 nt, Artificial Sequence
  Guide Sequence
agaccucuggcagccuuccuc

SEQ ID NO: 1516 - RNA, 21 nt, Artificial Sequence
  Guide Sequence
agaggucugacgaacuccugc

SEQ ID NO: 1517 - RNA, 21 nt, Artificial Sequence
  Guide Sequence
agcaggaguucgucagaccuc

SEQ ID NO: 1518 - RNA, 21 nt, Artificial Sequence
  Guide Sequence
aggaaggcugccagaggucug

SEQ ID NO: 1519 - RNA, 21 nt, Artificial Sequence
  Guide Sequence
aggaguucgucagaccucugg

SEQ ID NO: 1520 - RNA, 21 nt, Artificial Sequence
  Guide Sequence
aggcugccagaggucugacga

SEQ ID NO: 1521 - RNA, 21 nt, Artificial Sequence
  Guide Sequence
aggucugacgaacuccugcug

SEQ ID NO: 1522 - RNA, 21 nt, Artificial Sequence
  Guide Sequence
aguucgucagaccucuggcag

SEQ ID NO: 1523 - RNA, 21 nt, Artificial Sequence
  Guide Sequence
cagaccucuggcagccuuccu

SEQ ID NO: 1524 - RNA, 21 nt, Artificial Sequence
  Guide Sequence
cagaggucugacgaacuccug

SEQ ID NO: 1525 - RNA, 21 nt, Artificial Sequence
  Guide Sequence
cagcaggaguucgucagaccu

SEQ ID NO: 1526 - RNA, 21 nt, Artificial Sequence
  Guide Sequence
caggaguucgucagaccucug

SEQ ID NO: 1527 - RNA, 21 nt, Artificial Sequence
  Guide Sequence
ccagaggucugacgaacuccu

SEQ ID NO: 1528 - RNA, 21 nt, Artificial Sequence
  Guide Sequence
ccagcaggaguucgucagacc

SEQ ID NO: 1529 - RNA, 21 nt, Artificial Sequence
  Guide Sequence
cgucagaccucuggcagccuu

SEQ ID NO: 1530 - RNA, 21 nt, Artificial Sequence
  Guide Sequence
cugccagaggucugacgaacu

SEQ ID NO: 1531 - RNA, 21 nt, Artificial Sequence
  Guide Sequence
cuuuuugaggaaggcugccag

SEQ ID NO: 1532 - RNA, 21 nt, Artificial Sequence
  Guide Sequence
gaaccagcaggaguucgucag

SEQ ID NO: 1533 - RNA, 21 nt, Artificial Sequence
  Guide Sequence
gaaggcugccagaggucugac

SEQ ID NO: 1534 - RNA, 21 nt, Artificial Sequence
  Guide Sequence
gaccucuggcagccuuccuca

SEQ ID NO: 1535 - RNA, 21 nt, Artificial Sequence
  Guide Sequence
gaggaaggcugccagaggucu

SEQ ID NO: 1536 - RNA, 21 nt, Artificial Sequence
  Guide Sequence
gaggucugacgaacuccugcu

SEQ ID NO: 1537 - RNA, 21 nt, Artificial Sequence
  Guide Sequence
gaguucgucagaccucuggca

SEQ ID NO: 1538 - RNA, 21 nt, Artificial Sequence
  Guide Sequence
gcaggaguucgucagaccucu

SEQ ID NO: 1539 - RNA, 21 nt, Artificial Sequence
  Guide Sequence
gccagaggucugacgaacucc

SEQ ID NO: 1540 - RNA, 21 nt, Artificial Sequence
  Guide Sequence
gcugccagaggucugacgaac

SEQ ID NO: 1541 - RNA, 21 nt, Artificial Sequence
  Guide Sequence
ggaaggcugccagaggucuga

SEQ ID NO: 1542 - RNA, 21 nt, Artificial Sequence
  Guide Sequence
ggaguucgucagaccucuggc

SEQ ID NO: 1543 - RNA, 21 nt, Artificial Sequence
  Guide Sequence
ggcugccagaggucugacgaa

SEQ ID NO: 1544 - RNA, 21 nt, Artificial Sequence
  Guide Sequence
ggucugacgaacuccugcugg

SEQ ID NO: 1545 - RNA, 21 nt, Artificial Sequence
  Guide Sequence
gucagaccucuggcagccuuc

SEQ ID NO: 1546 - RNA, 21 nt, Artificial Sequence
  Guide Sequence
gugaaccagcaggaguucguc

SEQ ID NO: 1547 - RNA, 21 nt, Artificial Sequence
  Guide Sequence
guucgucagaccucuggcagc

SEQ ID NO: 1548 - RNA, 21 nt, Artificial Sequence
  Guide Sequence
ucagaccucuggcagccuucc

SEQ ID NO: 1549 - RNA, 21 nt, Artificial Sequence
  Guide Sequence
ucgucagaccucuggcagccu

SEQ ID NO: 1550 - RNA, 21 nt, Artificial Sequence
  Guide Sequence
ugaaccagcaggaguucguca

SEQ ID NO: 1551 - RNA, 21 nt, Artificial Sequence
  Guide Sequence
ugaggaaggcugccagagguc

SEQ ID NO: 1552 - RNA, 21 nt, Artificial Sequence
  Guide Sequence
ugccagaggucugacgaacuc

SEQ ID NO: 1553 - RNA, 21 nt, Artificial Sequence
  Guide Sequence
uucgucagaccucuggcagcc

SEQ ID NO: 1554 - RNA, 21 nt, Artificial Sequence
  Guide Sequence
uugaggaaggcugccagaggu

SEQ ID NO: 1555 - RNA, 21 nt, Artificial Sequence
  Guide Sequence
uuugaggaaggcugccagagg

SEQ ID NO: 1556 - RNA, 21 nt, Artificial Sequence
  Guide Sequence
uuuugaggaaggcugccagag

SEQ ID NO: 1557 - RNA, 21 nt, Artificial Sequence
  Guide Sequence
uuuuugaggaaggcugccaga

SEQ ID NO: 1558 - RNA, 22 nt, Artificial Sequence
  Guide Sequence
aaccagcaggaguucgucagac

SEQ ID NO: 1559 - RNA, 22 nt, Artificial Sequence
  Guide Sequence
aaggcugccagaggucugacga

SEQ ID NO: 1560 - RNA, 22 nt, Artificial Sequence
  Guide Sequence
accagcaggaguucgucagacc

SEQ ID NO: 1561 - RNA, 22 nt, Artificial Sequence
  Guide Sequence
accucuggcagccuuccucaaa

SEQ ID NO: 1562 - RNA, 22 nt, Artificial Sequence
  Guide Sequence
acuuuuugaggaaggcugccag

SEQ ID NO: 1563 - RNA, 22 nt, Artificial Sequence
  Guide Sequence
agaccucuggcagccuuccuca

SEQ ID NO: 1564 - RNA, 22 nt, Artificial Sequence
  Guide Sequence
agaggucugacgaacuccugcu

SEQ ID NO: 1565 - RNA, 22 nt, Artificial Sequence
  Guide Sequence
agcaggaguucgucagaccucu

SEQ ID NO: 1566 - RNA, 22 nt, Artificial Sequence
  Guide Sequence
aggaaggcugccagaggucuga

SEQ ID NO: 1567 - RNA, 22 nt, Artificial Sequence
  Guide Sequence
aggaguucgucagaccucuggc

SEQ ID NO: 1568 - RNA, 22 nt, Artificial Sequence
  Guide Sequence
aggcugccagaggucugacgaa

SEQ ID NO: 1569 - RNA, 22 nt, Artificial Sequence
  Guide Sequence
aggucugacgaacuccugcugg

SEQ ID NO: 1570 - RNA, 22 nt, Artificial Sequence
  Guide Sequence
aguucgucagaccucuggcagc

SEQ ID NO: 1571 - RNA, 22 nt, Artificial Sequence
  Guide Sequence
cacuuuuugaggaaggcugcca

SEQ ID NO: 1572 - RNA, 22 nt, Artificial Sequence
  Guide Sequence
cagaccucuggcagccuuccuc

SEQ ID NO: 1573 - RNA, 22 nt, Artificial Sequence
  Guide Sequence
cagaggucugacgaacuccugc

SEQ ID NO: 1574 - RNA, 22 nt, Artificial Sequence
  Guide Sequence
cagcaggaguucgucagaccuc

SEQ ID NO: 1575 - RNA, 22 nt, Artificial Sequence
  Guide Sequence
caggaguucgucagaccucugg

SEQ ID NO: 1576 - RNA, 22 nt, Artificial Sequence
  Guide Sequence
ccagaggucugacgaacuccug

SEQ ID NO: 1577 - RNA, 22 nt, Artificial Sequence
  Guide Sequence
ccagcaggaguucgucagaccu

SEQ ID NO: 1578 - RNA, 22 nt, Artificial Sequence
  Guide Sequence
cgucagaccucuggcagccuuc

SEQ ID NO: 1579 - RNA, 22 nt, Artificial Sequence
  Guide Sequence
cgugaaccagcaggaguucguc

SEQ ID NO: 1580 - RNA, 22 nt, Artificial Sequence
  Guide Sequence
cugccagaggucugacgaacuc

SEQ ID NO: 1581 - RNA, 22 nt, Artificial Sequence
  Guide Sequence
cuuuuugaggaaggcugccaga

SEQ ID NO: 1582 - RNA, 22 nt, Artificial Sequence
  Guide Sequence
gaaccagcaggaguucgucaga

SEQ ID NO: 1583 - RNA, 22 nt, Artificial Sequence
  Guide Sequence
gaaggcugccagaggucugacg

SEQ ID NO: 1584 - RNA, 22 nt, Artificial Sequence
  Guide Sequence
gaccucuggcagccuuccucaa

SEQ ID NO: 1585 - RNA, 22 nt, Artificial Sequence
  Guide Sequence
gaggaaggcugccagaggucug

SEQ ID NO: 1586 - RNA, 22 nt, Artificial Sequence
  Guide Sequence
gaggucugacgaacuccugcug

SEQ ID NO: 1587 - RNA, 22 nt, Artificial Sequence
  Guide Sequence
gaguucgucagaccucuggcag

SEQ ID NO: 1588 - RNA, 22 nt, Artificial Sequence
  Guide Sequence
gcaggaguucgucagaccucug

SEQ ID NO: 1589 - RNA, 22 nt, Artificial Sequence
  Guide Sequence
gccagaggucugacgaacuccu

SEQ ID NO: 1590 - RNA, 22 nt, Artificial Sequence
  Guide Sequence
gcugccagaggucugacgaacu

SEQ ID NO: 1591 - RNA, 22 nt, Artificial Sequence
  Guide Sequence
ggaaggcugccagaggucugac

SEQ ID NO: 1592 - RNA, 22 nt, Artificial Sequence
  Guide Sequence
ggaguucgucagaccucuggca

SEQ ID NO: 1593 - RNA, 22 nt, Artificial Sequence
  Guide Sequence
ggcugccagaggucugacgaac

SEQ ID NO: 1594 - RNA, 22 nt, Artificial Sequence
  Guide Sequence
ggucugacgaacuccugcuggu

SEQ ID NO: 1595 - RNA, 22 nt, Artificial Sequence
  Guide Sequence
gucagaccucuggcagccuucc

SEQ ID NO: 1596 - RNA, 22 nt, Artificial Sequence
  Guide Sequence
gugaaccagcaggaguucguca

SEQ ID NO: 1597 - RNA, 22 nt, Artificial Sequence
  Guide Sequence
guucgucagaccucuggcagcc

SEQ ID NO: 1598 - RNA, 22 nt, Artificial Sequence
  Guide Sequence
ucagaccucuggcagccuuccu

SEQ ID NO: 1599 - RNA, 22 nt, Artificial Sequence
  Guide Sequence
ucgucagaccucuggcagccuu

SEQ ID NO: 1600 - RNA, 22 nt, Artificial Sequence
  Guide Sequence
ugaaccagcaggaguucgucag

SEQ ID NO: 1601 - RNA, 22 nt, Artificial Sequence
  Guide Sequence
ugaggaaggcugccagaggucu

SEQ ID NO: 1602 - RNA, 22 nt, Artificial Sequence
  Guide Sequence
ugccagaggucugacgaacucc

SEQ ID NO: 1603 - RNA, 22 nt, Artificial Sequence
  Guide Sequence
uucgucagaccucuggcagccu

SEQ ID NO: 1604 - RNA, 22 nt, Artificial Sequence
  Guide Sequence
uugaggaaggcugccagagguc

SEQ ID NO: 1605 - RNA, 22 nt, Artificial Sequence
  Guide Sequence
uuugaggaaggcugccagaggu

SEQ ID NO: 1606 - RNA, 22 nt, Artificial Sequence
  Guide Sequence
uuuugaggaaggcugccagagg

SEQ ID NO: 1607 - RNA, 22 nt, Artificial Sequence
  Guide Sequence
uuuuugaggaaggcugccagag

SEQ ID NO: 1608 - RNA, 20 nt, Artificial Sequence
  Guide Sequence
aaacucacuuucugaggaag

SEQ ID NO: 1609 - RNA, 20 nt, Artificial Sequence
  Guide Sequence
aacucacuuucugaggaagg

SEQ ID NO: 1610 - RNA, 20 nt, Artificial Sequence
  Guide Sequence
accucaguccccaaacucac

SEQ ID NO: 1611 - RNA, 20 nt, Artificial Sequence
  Guide Sequence
acucacuuucugaggaaggc

SEQ ID NO: 1612 - RNA, 20 nt, Artificial Sequence
  Guide Sequence
acuuucugaggaaggcugcc

SEQ ID NO: 1613 - RNA, 20 nt, Artificial Sequence
  Guide Sequence
agaaagugaguuuggggacu

SEQ ID NO: 1614 - RNA, 20 nt, Artificial Sequence
  Guide Sequence
agagcucuggcagccuuccu

SEQ ID NO: 1615 - RNA, 20 nt, Artificial Sequence
  Guide Sequence
agccuuccucagaaagugag

SEQ ID NO: 1616 - RNA, 20 nt, Artificial Sequence
  Guide Sequence
agcucuggcagccuuccuca

SEQ ID NO: 1617 - RNA, 20 nt, Artificial Sequence
  Guide Sequence
aguccccaaacucacuuucu

SEQ ID NO: 1618 - RNA, 20 nt, Artificial Sequence
  Guide Sequence
caaacucacuuucugaggaa

SEQ ID NO: 1619 - RNA, 20 nt, Artificial Sequence
  Guide Sequence
cacuuucugaggaaggcugc

SEQ ID NO: 1620 - RNA, 20 nt, Artificial Sequence
  Guide Sequence
cagaaagugaguuuggggac

SEQ ID NO: 1621 - RNA, 20 nt, Artificial Sequence
  Guide Sequence
cagagcucuggcagccuucc

SEQ ID NO: 1622 - RNA, 20 nt, Artificial Sequence
  Guide Sequence
cagccuuccucagaaaguga

SEQ ID NO: 1623 - RNA, 20 nt, Artificial Sequence
  Guide Sequence
caguccccaaacucacuuuc

SEQ ID NO: 1624 - RNA, 20 nt, Artificial Sequence
  Guide Sequence
ccaaacucacuuucugagga

SEQ ID NO: 1625 - RNA, 20 nt, Artificial Sequence
  Guide Sequence
cccaaacucacuuucugagg

SEQ ID NO: 1626 - RNA, 20 nt, Artificial Sequence
  Guide Sequence
ccccaaacucacuuucugag

SEQ ID NO: 1627 - RNA, 20 nt, Artificial Sequence
  Guide Sequence
ccucagaaagugaguuuggg

SEQ ID NO: 1628 - RNA, 20 nt, Artificial Sequence
  Guide Sequence
ccucaguccccaaacucacu

SEQ ID NO: 1629 - RNA, 20 nt, Artificial Sequence
  Guide Sequence
ccuuccucagaaagugaguu

SEQ ID NO: 1630 - RNA, 20 nt, Artificial Sequence
  Guide Sequence
cucacuuucugaggaaggcu

SEQ ID NO: 1631 - RNA, 20 nt, Artificial Sequence
  Guide Sequence
cucagaaagugaguuugggg

SEQ ID NO: 1632 - RNA, 20 nt, Artificial Sequence
  Guide Sequence
cucaguccccaaacucacuu

SEQ ID NO: 1633 - RNA, 20 nt, Artificial Sequence
  Guide Sequence
cucuggcagccuuccucaga

SEQ ID NO: 1634 - RNA, 20 nt, Artificial Sequence
  Guide Sequence
cuggcagccuuccucagaaa

SEQ ID NO: 1635 - RNA, 20 nt, Artificial Sequence
  Guide Sequence
cuuccucagaaagugaguuu

SEQ ID NO: 1636 - RNA, 20 nt, Artificial Sequence
  Guide Sequence
cuuucugaggaaggcugcca

SEQ ID NO: 1637 - RNA, 20 nt, Artificial Sequence
  Guide Sequence
gagcucuggcagccuuccuc

SEQ ID NO: 1638 - RNA, 20 nt, Artificial Sequence
  Guide Sequence
gcagccuuccucagaaagug

SEQ ID NO: 1639 - RNA, 20 nt, Artificial Sequence
  Guide Sequence
gccuuccucagaaagugagu

SEQ ID NO: 1640 - RNA, 20 nt, Artificial Sequence
  Guide Sequence
gcucuggcagccuuccucag

SEQ ID NO: 1641 - RNA, 20 nt, Artificial Sequence
  Guide Sequence
ggcagccuuccucagaaagu

SEQ ID NO: 1642 - RNA, 20 nt, Artificial Sequence
  Guide Sequence
guccccaaacucacuuucug

SEQ ID NO: 1643 - RNA, 20 nt, Artificial Sequence
  Guide Sequence
ucacuuucugaggaaggcug

SEQ ID NO: 1644 - RNA, 20 nt, Artificial Sequence
  Guide Sequence
ucagaaagugaguuugggga

SEQ ID NO: 1645 - RNA, 20 nt, Artificial Sequence
  Guide Sequence
ucaguccccaaacucacuuu

SEQ ID NO: 1646 - RNA, 20 nt, Artificial Sequence
  Guide Sequence
uccccaaacucacuuucuga

SEQ ID NO: 1647 - RNA, 20 nt, Artificial Sequence
  Guide Sequence
uccucagaaagugaguuugg

SEQ ID NO: 1648 - RNA, 20 nt, Artificial Sequence
  Guide Sequence
ucugaggaaggcugccagag

SEQ ID NO: 1649 - RNA, 20 nt, Artificial Sequence
  Guide Sequence
ucuggcagccuuccucagaa

SEQ ID NO: 1650 - RNA, 20 nt, Artificial Sequence
  Guide Sequence
uggcagccuuccucagaaag

SEQ ID NO: 1651 - RNA, 20 nt, Artificial Sequence
  Guide Sequence
uuccucagaaagugaguuug

SEQ ID NO: 1652 - RNA, 20 nt, Artificial Sequence
  Guide Sequence
uucugaggaaggcugccaga

SEQ ID NO: 1653 - RNA, 20 nt, Artificial Sequence
  Guide Sequence
uuucugaggaaggcugccag

SEQ ID NO: 1654 - RNA, 21 nt, Artificial Sequence
  Guide Sequence
aaacucacuuucugaggaagg

SEQ ID NO: 1655 - RNA, 21 nt, Artificial Sequence
  Guide Sequence
aaccucaguccccaaacucac

SEQ ID NO: 1656 - RNA, 21 nt, Artificial Sequence
  Guide Sequence
aacucacuuucugaggaaggc

SEQ ID NO: 1657 - RNA, 21 nt, Artificial Sequence
  Guide Sequence
accucaguccccaaacucacu

SEQ ID NO: 1658 - RNA, 21 nt, Artificial Sequence
  Guide Sequence
acucacuuucugaggaaggcu

SEQ ID NO: 1659 - RNA, 21 nt, Artificial Sequence
  Guide Sequence
acuuucugaggaaggcugcca

SEQ ID NO: 1660 - RNA, 21 nt, Artificial Sequence
  Guide Sequence
agaaagugaguuuggggacug

SEQ ID NO: 1661 - RNA, 21 nt, Artificial Sequence
  Guide Sequence
agagcucuggcagccuuccuc

SEQ ID NO: 1662 - RNA, 21 nt, Artificial Sequence
  Guide Sequence
agccuuccucagaaagugagu

SEQ ID NO: 1663 - RNA, 21 nt, Artificial Sequence
  Guide Sequence
agcucuggcagccuuccucag

SEQ ID NO: 1664 - RNA, 21 nt, Artificial Sequence
  Guide Sequence
aguccccaaacucacuuucug

SEQ ID NO: 1665 - RNA, 21 nt, Artificial Sequence
  Guide Sequence
caaacucacuuucugaggaag

SEQ ID NO: 1666 - RNA, 21 nt, Artificial Sequence
  Guide Sequence
cacuuucugaggaaggcugcc

SEQ ID NO: 1667 - RNA, 21 nt, Artificial Sequence
  Guide Sequence
cagaaagugaguuuggggacu

SEQ ID NO: 1668 - RNA, 21 nt, Artificial Sequence
  Guide Sequence
cagagcucuggcagccuuccu

SEQ ID NO: 1669 - RNA, 21 nt, Artificial Sequence
  Guide Sequence
cagccuuccucagaaagugag

SEQ ID NO: 1670 - RNA, 21 nt, Artificial Sequence
  Guide Sequence
caguccccaaacucacuuucu

SEQ ID NO: 1671 - RNA, 21 nt, Artificial Sequence
  Guide Sequence
ccaaacucacuuucugaggaa

SEQ ID NO: 1672 - RNA, 21 nt, Artificial Sequence
  Guide Sequence
cccaaacucacuuucugagga

SEQ ID NO: 1673 - RNA, 21 nt, Artificial Sequence
  Guide Sequence
ccccaaacucacuuucugagg

SEQ ID NO: 1674 - RNA, 21 nt, Artificial Sequence
  Guide Sequence
ccucagaaagugaguuugggg

SEQ ID NO: 1675 - RNA, 21 nt, Artificial Sequence
  Guide Sequence
ccucaguccccaaacucacuu

SEQ ID NO: 1676 - RNA, 21 nt, Artificial Sequence
  Guide Sequence
ccuuccucagaaagugaguuu

SEQ ID NO: 1677 - RNA, 21 nt, Artificial Sequence
  Guide Sequence
cucacuuucugaggaaggcug

SEQ ID NO: 1678 - RNA, 21 nt, Artificial Sequence
  Guide Sequence
cucagaaagugaguuugggga

SEQ ID NO: 1679 - RNA, 21 nt, Artificial Sequence
  Guide Sequence
cucaguccccaaacucacuuu

SEQ ID NO: 1680 - RNA, 21 nt, Artificial Sequence
  Guide Sequence
cucuggcagccuuccucagaa

SEQ ID NO: 1681 - RNA, 21 nt, Artificial Sequence
  Guide Sequence
cuggcagccuuccucagaaag

SEQ ID NO: 1682 - RNA, 21 nt, Artificial Sequence
  Guide Sequence
cuuccucagaaagugaguuug

SEQ ID NO: 1683 - RNA, 21 nt, Artificial Sequence
  Guide Sequence
cuuucugaggaaggcugccag

SEQ ID NO: 1684 - RNA, 21 nt, Artificial Sequence
  Guide Sequence
gagcucuggcagccuuccuca

SEQ ID NO: 1685 - RNA, 21 nt, Artificial Sequence
  Guide Sequence
gcagccuuccucagaaaguga

SEQ ID NO: 1686 - RNA, 21 nt, Artificial Sequence
  Guide Sequence
gccuuccucagaaagugaguu

SEQ ID NO: 1687 - RNA, 21 nt, Artificial Sequence
  Guide Sequence
gcucuggcagccuuccucaga

SEQ ID NO: 1688 - RNA, 21 nt, Artificial Sequence
  Guide Sequence
ggcagccuuccucagaaagug

SEQ ID NO: 1689 - RNA, 21 nt, Artificial Sequence
  Guide Sequence
guccccaaacucacuuucuga

SEQ ID NO: 1690 - RNA, 21 nt, Artificial Sequence
  Guide Sequence
ucacuuucugaggaaggcugc

SEQ ID NO: 1691 - RNA, 21 nt, Artificial Sequence
  Guide Sequence
ucagaaagugaguuuggggac

SEQ ID NO: 1692 - RNA, 21 nt, Artificial Sequence
  Guide Sequence
ucagagcucuggcagccuucc

SEQ ID NO: 1693 - RNA, 21 nt, Artificial Sequence
  Guide Sequence
ucaguccccaaacucacuuuc

SEQ ID NO: 1694 - RNA, 21 nt, Artificial Sequence
  Guide Sequence
uccccaaacucacuuucugag

SEQ ID NO: 1695 - RNA, 21 nt, Artificial Sequence
  Guide Sequence
uccucagaaagugaguuuggg

SEQ ID NO: 1696 - RNA, 21 nt, Artificial Sequence
  Guide Sequence
ucugaggaaggcugccagagc

SEQ ID NO: 1697 - RNA, 21 nt, Artificial Sequence
  Guide Sequence
ucuggcagccuuccucagaaa

SEQ ID NO: 1698 - RNA, 21 nt, Artificial Sequence
  Guide Sequence
uggcagccuuccucagaaagu

SEQ ID NO: 1699 - RNA, 21 nt, Artificial Sequence
  Guide Sequence
uuccucagaaagugaguuugg

SEQ ID NO: 1700 - RNA, 21 nt, Artificial Sequence
  Guide Sequence
uucugaggaaggcugccagag

SEQ ID NO: 1701 - RNA, 21 nt, Artificial Sequence
  Guide Sequence
uuucugaggaaggcugccaga

SEQ ID NO: 1702 - RNA, 22 nt, Artificial Sequence
  Guide Sequence
aaacucacuuucugaggaaggc

SEQ ID NO: 1703 - RNA, 22 nt, Artificial Sequence
  Guide Sequence
aaccucaguccccaaacucacu

SEQ ID NO: 1704 - RNA, 22 nt, Artificial Sequence
  Guide Sequence
aacucacuuucugaggaaggcu

SEQ ID NO: 1705 - RNA, 22 nt, Artificial Sequence
  Guide Sequence
accucaguccccaaacucacuu

SEQ ID NO: 1706 - RNA, 22 nt, Artificial Sequence
  Guide Sequence
acucacuuucugaggaaggcug

SEQ ID NO: 1707 - RNA, 22 nt, Artificial Sequence
  Guide Sequence
acuuucugaggaaggcugccag

SEQ ID NO: 1708 - RNA, 22 nt, Artificial Sequence
  Guide Sequence
agaaagugaguuuggggacuga

SEQ ID NO: 1709 - RNA, 22 nt, Artificial Sequence
  Guide Sequence
agagcucuggcagccuuccuca

SEQ ID NO: 1710 - RNA, 22 nt, Artificial Sequence
  Guide Sequence
agccuuccucagaaagugaguu

SEQ ID NO: 1711 - RNA, 22 nt, Artificial Sequence
  Guide Sequence
agcucuggcagccuuccucaga

SEQ ID NO: 1712 - RNA, 22 nt, Artificial Sequence
  Guide Sequence
aguccccaaacucacuuucuga

SEQ ID NO: 1713 - RNA, 22 nt, Artificial Sequence
  Guide Sequence
caaacucacuuucugaggaagg

SEQ ID NO: 1714 - RNA, 22 nt, Artificial Sequence
  Guide Sequence
cacuuucugaggaaggcugcca

SEQ ID NO: 1715 - RNA, 22 nt, Artificial Sequence
  Guide Sequence
cagaaagugaguuuggggacug

SEQ ID NO: 1716 - RNA, 22 nt, Artificial Sequence
  Guide Sequence
cagagcucuggcagccuuccuc

SEQ ID NO: 1717 - RNA, 22 nt, Artificial Sequence
  Guide Sequence
cagccuuccucagaaagugagu

SEQ ID NO: 1718 - RNA, 22 nt, Artificial Sequence
  Guide Sequence
caguccccaaacucacuuucug

SEQ ID NO: 1719 - RNA, 22 nt, Artificial Sequence
  Guide Sequence
ccaaacucacuuucugaggaag

SEQ ID NO: 1720 - RNA, 22 nt, Artificial Sequence
  Guide Sequence
cccaaacucacuuucugaggaa

SEQ ID NO: 1721 - RNA, 22 nt, Artificial Sequence
  Guide Sequence
ccccaaacucacuuucugagga

SEQ ID NO: 1722 - RNA, 22 nt, Artificial Sequence
  Guide Sequence
ccucagaaagugaguuugggga

SEQ ID NO: 1723 - RNA, 22 nt, Artificial Sequence
  Guide Sequence
ccucaguccccaaacucacuuu

SEQ ID NO: 1724 - RNA, 22 nt, Artificial Sequence
  Guide Sequence
ccuuccucagaaagugaguuug

SEQ ID NO: 1725 - RNA, 22 nt, Artificial Sequence
  Guide Sequence
cucacuuucugaggaaggcugc

SEQ ID NO: 1726 - RNA, 22 nt, Artificial Sequence
  Guide Sequence
cucagaaagugaguuuggggac

SEQ ID NO: 1727 - RNA, 22 nt, Artificial Sequence
  Guide Sequence
cucaguccccaaacucacuuuc

SEQ ID NO: 1728 - RNA, 22 nt, Artificial Sequence
  Guide Sequence
cucuggcagccuuccucagaaa

SEQ ID NO: 1729 - RNA, 22 nt, Artificial Sequence
  Guide Sequence
cuggcagccuuccucagaaagu

SEQ ID NO: 1730 - RNA, 22 nt, Artificial Sequence
  Guide Sequence
cuuccucagaaagugaguuugg

SEQ ID NO: 1731 - RNA, 22 nt, Artificial Sequence
  Guide Sequence
cuuucugaggaaggcugccaga

SEQ ID NO: 1732 - RNA, 22 nt, Artificial Sequence
  Guide Sequence
gaaccucaguccccaaacucac

SEQ ID NO: 1733 - RNA, 22 nt, Artificial Sequence
  Guide Sequence
gagcucuggcagccuuccucag

SEQ ID NO: 1734 - RNA, 22 nt, Artificial Sequence
  Guide Sequence
gcagccuuccucagaaagugag

SEQ ID NO: 1735 - RNA, 22 nt, Artificial Sequence
  Guide Sequence
gccuuccucagaaagugaguuu

SEQ ID NO: 1736 - RNA, 22 nt, Artificial Sequence
  Guide Sequence
gcucuggcagccuuccucagaa

SEQ ID NO: 1737 - RNA, 22 nt, Artificial Sequence
  Guide Sequence
ggcagccuuccucagaaaguga

SEQ ID NO: 1738 - RNA, 22 nt, Artificial Sequence
  Guide Sequence
gucagagcucuggcagccuucc

SEQ ID NO: 1739 - RNA, 22 nt, Artificial Sequence
  Guide Sequence
guccccaaacucacuuucugag

SEQ ID NO: 1740 - RNA, 22 nt, Artificial Sequence
  Guide Sequence
ucacuuucugaggaaggcugcc

SEQ ID NO: 1741 - RNA, 22 nt, Artificial Sequence
  Guide Sequence
ucagaaagugaguuuggggacu

SEQ ID NO: 1742 - RNA, 22 nt, Artificial Sequence
  Guide Sequence
ucagagcucuggcagccuuccu

SEQ ID NO: 1743 - RNA, 22 nt, Artificial Sequence
  Guide Sequence
ucaguccccaaacucacuuucu

SEQ ID NO: 1744 - RNA, 22 nt, Artificial Sequence
  Guide Sequence
uccccaaacucacuuucugagg

SEQ ID NO: 1745 - RNA, 22 nt, Artificial Sequence
  Guide Sequence
uccucagaaagugaguuugggg

SEQ ID NO: 1746 - RNA, 22 nt, Artificial Sequence
  Guide Sequence
ucugaggaaggcugccagagcu

SEQ ID NO: 1747 - RNA, 22 nt, Artificial Sequence
  Guide Sequence
ucuggcagccuuccucagaaag

SEQ ID NO: 1748 - RNA, 22 nt, Artificial Sequence
  Guide Sequence
uggcagccuuccucagaaagug

SEQ ID NO: 1749 - RNA, 22 nt, Artificial Sequence
  Guide Sequence
uuccucagaaagugaguuuggg

SEQ ID NO: 1750 - RNA, 22 nt, Artificial Sequence
  Guide Sequence
uucugaggaaggcugccagagc

SEQ ID NO: 1751 - RNA, 22 nt, Artificial Sequence
  Guide Sequence
uuucugaggaaggcugccagag

SEQ ID NO: 1752 - RNA, 20 nt, Artificial Sequence
  Guide Sequence
aaaaagugaguuugggacug

SEQ ID NO: 1753 - RNA, 20 nt, Artificial Sequence
  Guide Sequence
aaaagugaguuugggacuga

SEQ ID NO: 1754 - RNA, 20 nt, Artificial Sequence
  Guide Sequence
aaagugaguuugggacugag

SEQ ID NO: 1755 - RNA, 20 nt, Artificial Sequence
  Guide Sequence
aaccucagucccaaacucac

SEQ ID NO: 1756 - RNA, 20 nt, Artificial Sequence
  Guide Sequence
aagugaguuugggacugagg

SEQ ID NO: 1757 - RNA, 20 nt, Artificial Sequence
  Guide Sequence
acccguuuugaaccucaguc

SEQ ID NO: 1758 - RNA, 20 nt, Artificial Sequence
  Guide Sequence
accucagucccaaacucacu

SEQ ID NO: 1759 - RNA, 20 nt, Artificial Sequence
  Guide Sequence
agccuuccucaaaaagugag

SEQ ID NO: 1760 - RNA, 20 nt, Artificial Sequence
  Guide Sequence
agucccaaacucacuuuuug

SEQ ID NO: 1761 - RNA, 20 nt, Artificial Sequence
  Guide Sequence
agugaguuugggacugaggu

SEQ ID NO: 1762 - RNA, 20 nt, Artificial Sequence
  Guide Sequence
aguuugggacugagguucaa

SEQ ID NO: 1763 - RNA, 20 nt, Artificial Sequence
  Guide Sequence
caaaaagugaguuugggacu

SEQ ID NO: 1764 - RNA, 20 nt, Artificial Sequence
  Guide Sequence
caaacucacuuuuugaggaa

SEQ ID NO: 1765 - RNA, 20 nt, Artificial Sequence
  Guide Sequence
cacccguuuugaaccucagu

SEQ ID NO: 1766 - RNA, 20 nt, Artificial Sequence
  Guide Sequence
cagccuuccucaaaaaguga

SEQ ID NO: 1767 - RNA, 20 nt, Artificial Sequence
  Guide Sequence
cagucccaaacucacuuuuu

SEQ ID NO: 1768 - RNA, 20 nt, Artificial Sequence
  Guide Sequence
ccaaacucacuuuuugagga

SEQ ID NO: 1769 - RNA, 20 nt, Artificial Sequence
  Guide Sequence
cccaaacucacuuuuugagg

SEQ ID NO: 1770 - RNA, 20 nt, Artificial Sequence
  Guide Sequence
cccguuuugaaccucagucc

SEQ ID NO: 1771 - RNA, 20 nt, Artificial Sequence
  Guide Sequence
ccguuuugaaccucaguccc

SEQ ID NO: 1772 - RNA, 20 nt, Artificial Sequence
  Guide Sequence
ccucaaaaagugaguuuggg

SEQ ID NO: 1773 - RNA, 20 nt, Artificial Sequence
  Guide Sequence
ccucagucccaaacucacuu

SEQ ID NO: 1774 - RNA, 20 nt, Artificial Sequence
  Guide Sequence
ccuuccucaaaaagugaguu

SEQ ID NO: 1775 - RNA, 20 nt, Artificial Sequence
  Guide Sequence
cguuuugaaccucaguccca

SEQ ID NO: 1776 - RNA, 20 nt, Artificial Sequence
  Guide Sequence
cucaaaaagugaguuuggga

SEQ ID NO: 1777 - RNA, 20 nt, Artificial Sequence
  Guide Sequence
cucagucccaaacucacuuu

SEQ ID NO: 1778 - RNA, 20 nt, Artificial Sequence
  Guide Sequence
cuuccucaaaaagugaguuu

SEQ ID NO: 1779 - RNA, 20 nt, Artificial Sequence
  Guide Sequence
gaaccucagucccaaacuca

SEQ ID NO: 1780 - RNA, 20 nt, Artificial Sequence
  Guide Sequence
gaguuugggacugagguuca

SEQ ID NO: 1781 - RNA, 20 nt, Artificial Sequence
  Guide Sequence
gccuuccucaaaaagugagu

SEQ ID NO: 1782 - RNA, 20 nt, Artificial Sequence
  Guide Sequence
gucccaaacucacuuuuuga

SEQ ID NO: 1783 - RNA, 20 nt, Artificial Sequence
  Guide Sequence
gugaguuugggacugagguu

SEQ ID NO: 1784 - RNA, 20 nt, Artificial Sequence
  Guide Sequence
guuugggacugagguucaaa

SEQ ID NO: 1785 - RNA, 20 nt, Artificial Sequence
  Guide Sequence
guuuugaaccucagucccaa

SEQ ID NO: 1786 - RNA, 20 nt, Artificial Sequence
  Guide Sequence
ucaaaaagugaguuugggac

SEQ ID NO: 1787 - RNA, 20 nt, Artificial Sequence
  Guide Sequence
ucagucccaaacucacuuuu

SEQ ID NO: 1788 - RNA, 20 nt, Artificial Sequence
  Guide Sequence
ucccaaacucacuuuuugag

SEQ ID NO: 1789 - RNA, 20 nt, Artificial Sequence
  Guide Sequence
uccucaaaaagugaguuugg

SEQ ID NO: 1790 - RNA, 20 nt, Artificial Sequence
  Guide Sequence
ugaaccucagucccaaacuc

SEQ ID NO: 1791 - RNA, 20 nt, Artificial Sequence
  Guide Sequence
ugaguuugggacugagguuc

SEQ ID NO: 1792 - RNA, 20 nt, Artificial Sequence
  Guide Sequence
uuccucaaaaagugaguuug

SEQ ID NO: 1793 - RNA, 20 nt, Artificial Sequence
  Guide Sequence
uugaaccucagucccaaacu

SEQ ID NO: 1794 - RNA, 20 nt, Artificial Sequence
  Guide Sequence
uugggacugagguucaaaac

SEQ ID NO: 1795 - RNA, 20 nt, Artificial Sequence
  Guide Sequence
uuugaaccucagucccaaac

SEQ ID NO: 1796 - RNA, 20 nt, Artificial Sequence
  Guide Sequence
uuugggacugagguucaaaa

SEQ ID NO: 1797 - RNA, 20 nt, Artificial Sequence
  Guide Sequence
uuuugaaccucagucccaaa

SEQ ID NO: 1798 - RNA, 21 nt, Artificial Sequence
  Guide Sequence
aaaaagugaguuugggacuga

SEQ ID NO: 1799 - RNA, 21 nt, Artificial Sequence
  Guide Sequence
aaaagugaguuugggacugag

SEQ ID NO: 1800 - RNA, 21 nt, Artificial Sequence
  Guide Sequence
aaagugaguuugggacugagg

SEQ ID NO: 1801 - RNA, 21 nt, Artificial Sequence
  Guide Sequence
aaccucagucccaaacucacu

SEQ ID NO: 1802 - RNA, 21 nt, Artificial Sequence
  Guide Sequence
aagugaguuugggacugaggu

SEQ ID NO: 1803 - RNA, 21 nt, Artificial Sequence
  Guide Sequence
acccguuuugaaccucagucc

SEQ ID NO: 1804 - RNA, 21 nt, Artificial Sequence
  Guide Sequence
accucagucccaaacucacuu

SEQ ID NO: 1805 - RNA, 21 nt, Artificial Sequence
  Guide Sequence
agccuuccucaaaaagugagu

SEQ ID NO: 1806 - RNA, 21 nt, Artificial Sequence
  Guide Sequence
agucccaaacucacuuuuuga

SEQ ID NO: 1807 - RNA, 21 nt, Artificial Sequence
  Guide Sequence
agugaguuugggacugagguu

SEQ ID NO: 1808 - RNA, 21 nt, Artificial Sequence
  Guide Sequence
aguuugggacugagguucaaa

SEQ ID NO: 1809 - RNA, 21 nt, Artificial Sequence
  Guide Sequence
caaaaagugaguuugggacug

SEQ ID NO: 1810 - RNA, 21 nt, Artificial Sequence
  Guide Sequence
caaacucacuuuuugaggaag

SEQ ID NO: 1811 - RNA, 21 nt, Artificial Sequence
  Guide Sequence
cacccguuuugaaccucaguc

SEQ ID NO: 1812 - RNA, 21 nt, Artificial Sequence
  Guide Sequence
cagccuuccucaaaaagugag

SEQ ID NO: 1813 - RNA, 21 nt, Artificial Sequence
  Guide Sequence
cagucccaaacucacuuuuug

SEQ ID NO: 1814 - RNA, 21 nt, Artificial Sequence
  Guide Sequence
ccaaacucacuuuuugaggaa

SEQ ID NO: 1815 - RNA, 21 nt, Artificial Sequence
  Guide Sequence
ccacccguuuugaaccucagu

SEQ ID NO: 1816 - RNA, 21 nt, Artificial Sequence
  Guide Sequence
cccaaacucacuuuuugagga

SEQ ID NO: 1817 - RNA, 21 nt, Artificial Sequence
  Guide Sequence
cccguuuugaaccucaguccc

SEQ ID NO: 1818 - RNA, 21 nt, Artificial Sequence
  Guide Sequence
ccguuuugaaccucaguccca

SEQ ID NO: 1819 - RNA, 21 nt, Artificial Sequence
  Guide Sequence
ccucaaaaagugaguuuggga

SEQ ID NO: 1820 - RNA, 21 nt, Artificial Sequence
  Guide Sequence
ccucagucccaaacucacuuu

SEQ ID NO: 1821 - RNA, 21 nt, Artificial Sequence
  Guide Sequence
ccuuccucaaaaagugaguuu

SEQ ID NO: 1822 - RNA, 21 nt, Artificial Sequence
  Guide Sequence
cguuuugaaccucagucccaa

SEQ ID NO: 1823 - RNA, 21 nt, Artificial Sequence
  Guide Sequence
cucaaaaagugaguuugggac

SEQ ID NO: 1824 - RNA, 21 nt, Artificial Sequence
  Guide Sequence
cucagucccaaacucacuuuu

SEQ ID NO: 1825 - RNA, 21 nt, Artificial Sequence
  Guide Sequence
cuuccucaaaaagugaguuug

SEQ ID NO: 1826 - RNA, 21 nt, Artificial Sequence
  Guide Sequence
gaaccucagucccaaacucac

SEQ ID NO: 1827 - RNA, 21 nt, Artificial Sequence
  Guide Sequence
gaguuugggacugagguucaa

SEQ ID NO: 1828 - RNA, 21 nt, Artificial Sequence
  Guide Sequence
gcagccuuccucaaaaaguga

SEQ ID NO: 1829 - RNA, 21 nt, Artificial Sequence
  Guide Sequence
gccuuccucaaaaagugaguu

SEQ ID NO: 1830 - RNA, 21 nt, Artificial Sequence
  Guide Sequence
gucccaaacucacuuuuugag

SEQ ID NO: 1831 - RNA, 21 nt, Artificial Sequence
  Guide Sequence
gugaguuugggacugagguuc

SEQ ID NO: 1832 - RNA, 21 nt, Artificial Sequence
  Guide Sequence
guuugggacugagguucaaaa

SEQ ID NO: 1833 - RNA, 21 nt, Artificial Sequence
  Guide Sequence
guuuugaaccucagucccaaa

SEQ ID NO: 1834 - RNA, 21 nt, Artificial Sequence
  Guide Sequence
ucaaaaagugaguuugggacu

SEQ ID NO: 1835 - RNA, 21 nt, Artificial Sequence
  Guide Sequence
ucagucccaaacucacuuuuu

SEQ ID NO: 1836 - RNA, 21 nt, Artificial Sequence
  Guide Sequence
ucccaaacucacuuuuugagg

SEQ ID NO: 1837 - RNA, 21 nt, Artificial Sequence
  Guide Sequence
uccucaaaaagugaguuuggg

SEQ ID NO: 1838 - RNA, 21 nt, Artificial Sequence
  Guide Sequence
ugaaccucagucccaaacuca

SEQ ID NO: 1839 - RNA, 21 nt, Artificial Sequence
  Guide Sequence
ugaguuugggacugagguuca

SEQ ID NO: 1840 - RNA, 21 nt, Artificial Sequence
  Guide Sequence
uuccucaaaaagugaguuugg

SEQ ID NO: 1841 - RNA, 21 nt, Artificial Sequence
  Guide Sequence
uugaaccucagucccaaacuc

SEQ ID NO: 1842 - RNA, 21 nt, Artificial Sequence
  Guide Sequence
uugggacugagguucaaaacg

SEQ ID NO: 1843 - RNA, 21 nt, Artificial Sequence
  Guide Sequence
uuugaaccucagucccaaacu

SEQ ID NO: 1844 - RNA, 21 nt, Artificial Sequence
  Guide Sequence
uuugggacugagguucaaaac

SEQ ID NO: 1845 - RNA, 21 nt, Artificial Sequence
  Guide Sequence
uuuugaaccucagucccaaac

SEQ ID NO: 1846 - RNA, 22 nt, Artificial Sequence
  Guide Sequence
aaaaagugaguuugggacugag

SEQ ID NO: 1847 - RNA, 22 nt, Artificial Sequence
  Guide Sequence
aaaagugaguuugggacugagg

SEQ ID NO: 1848 - RNA, 22 nt, Artificial Sequence
  Guide Sequence
aaagugaguuugggacugaggu

SEQ ID NO: 1849 - RNA, 22 nt, Artificial Sequence
  Guide Sequence
aaccucagucccaaacucacuu

SEQ ID NO: 1850 - RNA, 22 nt, Artificial Sequence
  Guide Sequence
aagugaguuugggacugagguu

SEQ ID NO: 1851 - RNA, 22 nt, Artificial Sequence
  Guide Sequence
acccguuuugaaccucaguccc

SEQ ID NO: 1852 - RNA, 22 nt, Artificial Sequence
  Guide Sequence
accucagucccaaacucacuuu

SEQ ID NO: 1853 - RNA, 22 nt, Artificial Sequence
  Guide Sequence
agccuuccucaaaaagugaguu

SEQ ID NO: 1854 - RNA, 22 nt, Artificial Sequence
  Guide Sequence
agucccaaacucacuuuuugag

SEQ ID NO: 1855 - RNA, 22 nt, Artificial Sequence
  Guide Sequence
agugaguuugggacugagguuc

SEQ ID NO: 1856 - RNA, 22 nt, Artificial Sequence
  Guide Sequence
aguuugggacugagguucaaaa

SEQ ID NO: 1857 - RNA, 22 nt, Artificial Sequence
  Guide Sequence
caaaaagugaguuugggacuga

SEQ ID NO: 1858 - RNA, 22 nt, Artificial Sequence
  Guide Sequence
caaacucacuuuuugaggaagg

SEQ ID NO: 1859 - RNA, 22 nt, Artificial Sequence
  Guide Sequence
cacccguuuugaaccucagucc

SEQ ID NO: 1860 - RNA, 22 nt, Artificial Sequence
  Guide Sequence
cagccuuccucaaaaagugagu

SEQ ID NO: 1861 - RNA, 22 nt, Artificial Sequence
  Guide Sequence
cagucccaaacucacuuuuuga

SEQ ID NO: 1862 - RNA, 22 nt, Artificial Sequence
  Guide Sequence
ccaaacucacuuuuugaggaag

SEQ ID NO: 1863 - RNA, 22 nt, Artificial Sequence
  Guide Sequence
ccacccguuuugaaccucaguc

SEQ ID NO: 1864 - RNA, 22 nt, Artificial Sequence
  Guide Sequence
cccaaacucacuuuuugaggaa

SEQ ID NO: 1865 - RNA, 22 nt, Artificial Sequence
  Guide Sequence
cccguuuugaaccucaguccca

SEQ ID NO: 1866 - RNA, 22 nt, Artificial Sequence
  Guide Sequence
ccguuuugaaccucagucccaa

SEQ ID NO: 1867 - RNA, 22 nt, Artificial Sequence
  Guide Sequence
ccucaaaaagugaguuugggac

SEQ ID NO: 1868 - RNA, 22 nt, Artificial Sequence
  Guide Sequence
ccucagucccaaacucacuuuu

SEQ ID NO: 1869 - RNA, 22 nt, Artificial Sequence
  Guide Sequence
ccuuccucaaaaagugaguuug

SEQ ID NO: 1870 - RNA, 22 nt, Artificial Sequence
  Guide Sequence
cguuuugaaccucagucccaaa

SEQ ID NO: 1871 - RNA, 22 nt, Artificial Sequence
  Guide Sequence
cucaaaaagugaguuugggacu

SEQ ID NO: 1872 - RNA, 22 nt, Artificial Sequence
  Guide Sequence
cucagucccaaacucacuuuuu

SEQ ID NO: 1873 - RNA, 22 nt, Artificial Sequence
  Guide Sequence
cuuccucaaaaagugaguuugg

SEQ ID NO: 1874 - RNA, 22 nt, Artificial Sequence
  Guide Sequence
gaaccucagucccaaacucacu

SEQ ID NO: 1875 - RNA, 22 nt, Artificial Sequence
  Guide Sequence
gaguuugggacugagguucaaa

SEQ ID NO: 1876 - RNA, 22 nt, Artificial Sequence
  Guide Sequence
gcagccuuccucaaaaagugag

SEQ ID NO: 1877 - RNA, 22 nt, Artificial Sequence
  Guide Sequence
gccuuccucaaaaagugaguuu

SEQ ID NO: 1878 - RNA, 22 nt, Artificial Sequence
  Guide Sequence
ggcagccuuccucaaaaaguga

SEQ ID NO: 1879 - RNA, 22 nt, Artificial Sequence
  Guide Sequence
gucccaaacucacuuuuugagg

SEQ ID NO: 1880 - RNA, 22 nt, Artificial Sequence
  Guide Sequence
gugaguuugggacugagguuca

SEQ ID NO: 1881 - RNA, 22 nt, Artificial Sequence
  Guide Sequence
guuugggacugagguucaaaac

SEQ ID NO: 1882 - RNA, 22 nt, Artificial Sequence
  Guide Sequence
guuuugaaccucagucccaaac

SEQ ID NO: 1883 - RNA, 22 nt, Artificial Sequence
  Guide Sequence
ucaaaaagugaguuugggacug

SEQ ID NO: 1884 - RNA, 22 nt, Artificial Sequence
  Guide Sequence
ucagucccaaacucacuuuuug

SEQ ID NO: 1885 - RNA, 22 nt, Artificial Sequence
  Guide Sequence
uccacccguuuugaaccucagu

SEQ ID NO: 1886 - RNA, 22 nt, Artificial Sequence
  Guide Sequence
ucccaaacucacuuuuugagga

SEQ ID NO: 1887 - RNA, 22 nt, Artificial Sequence
  Guide Sequence
uccucaaaaagugaguuuggga

SEQ ID NO: 1888 - RNA, 22 nt, Artificial Sequence
  Guide Sequence
ugaaccucagucccaaacucac

SEQ ID NO: 1889 - RNA, 22 nt, Artificial Sequence
  Guide Sequence
ugaguuugggacugagguucaa

SEQ ID NO: 1890 - RNA, 22 nt, Artificial Sequence
  Guide Sequence
uuccucaaaaagugaguuuggg

SEQ ID NO: 1891 - RNA, 22 nt, Artificial Sequence
  Guide Sequence
uugaaccucagucccaaacuca

SEQ ID NO: 1892 - RNA, 22 nt, Artificial Sequence
  Guide Sequence
uugggacugagguucaaaacgg

SEQ ID NO: 1893 - RNA, 22 nt, Artificial Sequence
  Guide Sequence
uuugaaccucagucccaaacuc

SEQ ID NO: 1894 - RNA, 22 nt, Artificial Sequence
  Guide Sequence
uuugggacugagguucaaaacg

SEQ ID NO: 1895 - RNA, 22 nt, Artificial Sequence
  Guide Sequence
uuuugaaccucagucccaaacu

SEQ ID NO: 1896 - RNA, 20 nt, Artificial Sequence
  Guide Sequence
aaguccgggaagcugaaagu

SEQ ID NO: 1897 - RNA, 20 nt, Artificial Sequence
  Guide Sequence
acuguuuuggucuuaagucc

SEQ ID NO: 1898 - RNA, 20 nt, Artificial Sequence
  Guide Sequence
acuuaagaccaaaacagugg

SEQ ID NO: 1899 - RNA, 20 nt, Artificial Sequence
  Guide Sequence
acuuucagcuucccggacuu

SEQ ID NO: 1900 - RNA, 20 nt, Artificial Sequence
  Guide Sequence
agcuucccggacuuaagacc

SEQ ID NO: 1901 - RNA, 20 nt, Artificial Sequence
  Guide Sequence
cacuguuuuggucuuaaguc

SEQ ID NO: 1902 - RNA, 20 nt, Artificial Sequence
  Guide Sequence
cagcuucccggacuuaagac

SEQ ID NO: 1903 - RNA, 20 nt, Artificial Sequence
  Guide Sequence
ccacuguuuuggucuuaagu

SEQ ID NO: 1904 - RNA, 20 nt, Artificial Sequence
  Guide Sequence
cccacuguuuuggucuuaag

SEQ ID NO: 1905 - RNA, 20 nt, Artificial Sequence
  Guide Sequence
cccggacuuaagaccaaaac

SEQ ID NO: 1906 - RNA, 20 nt, Artificial Sequence
  Guide Sequence
ccggacuuaagaccaaaaca

SEQ ID NO: 1907 - RNA, 20 nt, Artificial Sequence
  Guide Sequence
cggacuuaagaccaaaacag

SEQ ID NO: 1908 - RNA, 20 nt, Artificial Sequence
  Guide Sequence
cggggacuuucagcuucccg

SEQ ID NO: 1909 - RNA, 20 nt, Artificial Sequence
  Guide Sequence
cuguuuuggucuuaaguccg

SEQ ID NO: 1910 - RNA, 20 nt, Artificial Sequence
  Guide Sequence
cuuaagaccaaaacaguggg

SEQ ID NO: 1911 - RNA, 20 nt, Artificial Sequence
  Guide Sequence
cuuaaguccgggaagcugaa

SEQ ID NO: 1912 - RNA, 20 nt, Artificial Sequence
  Guide Sequence
cuucccggacuuaagaccaa

SEQ ID NO: 1913 - RNA, 20 nt, Artificial Sequence
  Guide Sequence
cuuucagcuucccggacuua

SEQ ID NO: 1914 - RNA, 20 nt, Artificial Sequence
  Guide Sequence
cuuuucccacuguuuugguc

SEQ ID NO: 1915 - RNA, 20 nt, Artificial Sequence
  Guide Sequence
gacuuaagaccaaaacagug

SEQ ID NO: 1916 - RNA, 20 nt, Artificial Sequence
  Guide Sequence
gacuuucagcuucccggacu

SEQ ID NO: 1917 - RNA, 20 nt, Artificial Sequence
  Guide Sequence
gcuucccggacuuaagacca

SEQ ID NO: 1918 - RNA, 20 nt, Artificial Sequence
  Guide Sequence
ggacuuaagaccaaaacagu

SEQ ID NO: 1919 - RNA, 20 nt, Artificial Sequence
  Guide Sequence
ggacuuucagcuucccggac

SEQ ID NO: 1920 - RNA, 20 nt, Artificial Sequence
  Guide Sequence
gggacuuucagcuucccgga

SEQ ID NO: 1921 - RNA, 20 nt, Artificial Sequence
  Guide Sequence
ggggacuuucagcuucccgg

SEQ ID NO: 1922 - RNA, 20 nt, Artificial Sequence
  Guide Sequence
ggucuuaaguccgggaagcu

SEQ ID NO: 1923 - RNA, 20 nt, Artificial Sequence
  Guide Sequence
gucuuaaguccgggaagcug

SEQ ID NO: 1924 - RNA, 20 nt, Artificial Sequence
  Guide Sequence
guuuuggucuuaaguccggg

SEQ ID NO: 1925 - RNA, 20 nt, Artificial Sequence
  Guide Sequence
uaaguccgggaagcugaaag

SEQ ID NO: 1926 - RNA, 20 nt, Artificial Sequence
  Guide Sequence
ucagcuucccggacuuaaga

SEQ ID NO: 1927 - RNA, 20 nt, Artificial Sequence
  Guide Sequence
ucccacuguuuuggucuuaa

SEQ ID NO: 1928 - RNA, 20 nt, Artificial Sequence
  Guide Sequence
ucccggacuuaagaccaaaa

SEQ ID NO: 1929 - RNA, 20 nt, Artificial Sequence
  Guide Sequence
ucuuaaguccgggaagcuga

SEQ ID NO: 1930 - RNA, 20 nt, Artificial Sequence
  Guide Sequence
uggucuuaaguccgggaagc

SEQ ID NO: 1931 - RNA, 20 nt, Artificial Sequence
  Guide Sequence
uguuuuggucuuaaguccgg

SEQ ID NO: 1932 - RNA, 20 nt, Artificial Sequence
  Guide Sequence
uuaaguccgggaagcugaaa

SEQ ID NO: 1933 - RNA, 20 nt, Artificial Sequence
  Guide Sequence
uucagcuucccggacuuaag

SEQ ID NO: 1934 - RNA, 20 nt, Artificial Sequence
  Guide Sequence
uucccacuguuuuggucuua

SEQ ID NO: 1935 - RNA, 20 nt, Artificial Sequence
  Guide Sequence
uucccggacuuaagaccaaa

SEQ ID NO: 1936 - RNA, 20 nt, Artificial Sequence
  Guide Sequence
uuggucuuaaguccgggaag

SEQ ID NO: 1937 - RNA, 20 nt, Artificial Sequence
  Guide Sequence
uuucagcuucccggacuuaa

SEQ ID NO: 1938 - RNA, 20 nt, Artificial Sequence
  Guide Sequence
uuucccacuguuuuggucuu

SEQ ID NO: 1939 - RNA, 20 nt, Artificial Sequence
  Guide Sequence
uuuggucuuaaguccgggaa

SEQ ID NO: 1940 - RNA, 20 nt, Artificial Sequence
  Guide Sequence
uuuucccacuguuuuggucu

SEQ ID NO: 1941 - RNA, 20 nt, Artificial Sequence
  Guide Sequence
uuuuggucuuaaguccggga

SEQ ID NO: 1942 - RNA, 21 nt, Artificial Sequence
  Guide Sequence
aaguccgggaagcugaaaguc

SEQ ID NO: 1943 - RNA, 21 nt, Artificial Sequence
  Guide Sequence
acuguuuuggucuuaaguccg

SEQ ID NO: 1944 - RNA, 21 nt, Artificial Sequence
  Guide Sequence
acuuaagaccaaaacaguggg

SEQ ID NO: 1945 - RNA, 21 nt, Artificial Sequence
  Guide Sequence
acuuucagcuucccggacuua

SEQ ID NO: 1946 - RNA, 21 nt, Artificial Sequence
  Guide Sequence
agcuucccggacuuaagacca

SEQ ID NO: 1947 - RNA, 21 nt, Artificial Sequence
  Guide Sequence
cacuguuuuggucuuaagucc

SEQ ID NO: 1948 - RNA, 21 nt, Artificial Sequence
  Guide Sequence
cagcuucccggacuuaagacc

SEQ ID NO: 1949 - RNA, 21 nt, Artificial Sequence
  Guide Sequence
ccacuguuuuggucuuaaguc

SEQ ID NO: 1950 - RNA, 21 nt, Artificial Sequence
  Guide Sequence
cccacuguuuuggucuuaagu

SEQ ID NO: 1951 - RNA, 21 nt, Artificial Sequence
  Guide Sequence
cccggacuuaagaccaaaaca

SEQ ID NO: 1952 - RNA, 21 nt, Artificial Sequence
  Guide Sequence
ccggacuuaagaccaaaacag

SEQ ID NO: 1953 - RNA, 21 nt, Artificial Sequence
  Guide Sequence
cggacuuaagaccaaaacagu

SEQ ID NO: 1954 - RNA, 21 nt, Artificial Sequence
  Guide Sequence
cggggacuuucagcuucccgg

SEQ ID NO: 1955 - RNA, 21 nt, Artificial Sequence
  Guide Sequence
cuguuuuggucuuaaguccgg

SEQ ID NO: 1956 - RNA, 21 nt, Artificial Sequence
  Guide Sequence
cuuaagaccaaaacaguggga

SEQ ID NO: 1957 - RNA, 21 nt, Artificial Sequence
  Guide Sequence
cuuaaguccgggaagcugaaa

SEQ ID NO: 1958 - RNA, 21 nt, Artificial Sequence
  Guide Sequence
cuucccggacuuaagaccaaa

SEQ ID NO: 1959 - RNA, 21 nt, Artificial Sequence
  Guide Sequence
cuuucagcuucccggacuuaa

SEQ ID NO: 1960 - RNA, 21 nt, Artificial Sequence
  Guide Sequence
cuuuucccacuguuuuggucu

SEQ ID NO: 1961 - RNA, 21 nt, Artificial Sequence
  Guide Sequence
gacuuaagaccaaaacagugg

SEQ ID NO: 1962 - RNA, 21 nt, Artificial Sequence
  Guide Sequence
gacuuucagcuucccggacuu

SEQ ID NO: 1963 - RNA, 21 nt, Artificial Sequence
  Guide Sequence
gcuucccggacuuaagaccaa

SEQ ID NO: 1964 - RNA, 21 nt, Artificial Sequence
  Guide Sequence
gcuuuucccacuguuuugguc

SEQ ID NO: 1965 - RNA, 21 nt, Artificial Sequence
  Guide Sequence
ggacuuaagaccaaaacagug

SEQ ID NO: 1966 - RNA, 21 nt, Artificial Sequence
  Guide Sequence
ggacuuucagcuucccggacu

SEQ ID NO: 1967 - RNA, 21 nt, Artificial Sequence
  Guide Sequence
gggacuuucagcuucccggac

SEQ ID NO: 1968 - RNA, 21 nt, Artificial Sequence
  Guide Sequence
ggggacuuucagcuucccgga

SEQ ID NO: 1969 - RNA, 21 nt, Artificial Sequence
  Guide Sequence
ggucuuaaguccgggaagcug

SEQ ID NO: 1970 - RNA, 21 nt, Artificial Sequence
  Guide Sequence
gucuuaaguccgggaagcuga

SEQ ID NO: 1971 - RNA, 21 nt, Artificial Sequence
  Guide Sequence
guuuuggucuuaaguccggga

SEQ ID NO: 1972 - RNA, 21 nt, Artificial Sequence
  Guide Sequence
uaaguccgggaagcugaaagu

SEQ ID NO: 1973 - RNA, 21 nt, Artificial Sequence
  Guide Sequence
ucagcuucccggacuuaagac

SEQ ID NO: 1974 - RNA, 21 nt, Artificial Sequence
  Guide Sequence
ucccacuguuuuggucuuaag

SEQ ID NO: 1975 - RNA, 21 nt, Artificial Sequence
  Guide Sequence
ucccggacuuaagaccaaaac

SEQ ID NO: 1976 - RNA, 21 nt, Artificial Sequence
  Guide Sequence
ucggggacuuucagcuucccg

SEQ ID NO: 1977 - RNA, 21 nt, Artificial Sequence
  Guide Sequence
ucuuaaguccgggaagcugaa

SEQ ID NO: 1978 - RNA, 21 nt, Artificial Sequence
  Guide Sequence
uggucuuaaguccgggaagcu

SEQ ID NO: 1979 - RNA, 21 nt, Artificial Sequence
  Guide Sequence
uguuuuggucuuaaguccggg

SEQ ID NO: 1980 - RNA, 21 nt, Artificial Sequence
  Guide Sequence
uuaaguccgggaagcugaaag

SEQ ID NO: 1981 - RNA, 21 nt, Artificial Sequence
  Guide Sequence
uucagcuucccggacuuaaga

SEQ ID NO: 1982 - RNA, 21 nt, Artificial Sequence
  Guide Sequence
uucccacuguuuuggucuuaa

SEQ ID NO: 1983 - RNA, 21 nt, Artificial Sequence
  Guide Sequence
uucccggacuuaagaccaaaa

SEQ ID NO: 1984 - RNA, 21 nt, Artificial Sequence
  Guide Sequence
uuggucuuaaguccgggaagc

SEQ ID NO: 1985 - RNA, 21 nt, Artificial Sequence
  Guide Sequence
uuucagcuucccggacuuaag

SEQ ID NO: 1986 - RNA, 21 nt, Artificial Sequence
  Guide Sequence
uuucccacuguuuuggucuua

SEQ ID NO: 1987 - RNA, 21 nt, Artificial Sequence
  Guide Sequence
uuuggucuuaaguccgggaag

SEQ ID NO: 1988 - RNA, 21 nt, Artificial Sequence
  Guide Sequence
uuuucccacuguuuuggucuu

SEQ ID NO: 1989 - RNA, 21 nt, Artificial Sequence
  Guide Sequence
uuuuggucuuaaguccgggaa

SEQ ID NO: 1990 - RNA, 22 nt, Artificial Sequence
  Guide Sequence
aaguccgggaagcugaaagucc

SEQ ID NO: 1991 - RNA, 22 nt, Artificial Sequence
  Guide Sequence
acuguuuuggucuuaaguccgg

SEQ ID NO: 1992 - RNA, 22 nt, Artificial Sequence
  Guide Sequence
acuuaagaccaaaacaguggga

SEQ ID NO: 1993 - RNA, 22 nt, Artificial Sequence
  Guide Sequence
acuuucagcuucccggacuuaa

SEQ ID NO: 1994 - RNA, 22 nt, Artificial Sequence
  Guide Sequence
agcuucccggacuuaagaccaa

SEQ ID NO: 1995 - RNA, 22 nt, Artificial Sequence
  Guide Sequence
cacuguuuuggucuuaaguccg

SEQ ID NO: 1996 - RNA, 22 nt, Artificial Sequence
  Guide Sequence
cagcuucccggacuuaagacca

SEQ ID NO: 1997 - RNA, 22 nt, Artificial Sequence
  Guide Sequence
ccacuguuuuggucuuaagucc

SEQ ID NO: 1998 - RNA, 22 nt, Artificial Sequence
  Guide Sequence
cccacuguuuuggucuuaaguc

SEQ ID NO: 1999 - RNA, 22 nt, Artificial Sequence
  Guide Sequence
cccggacuuaagaccaaaacag

SEQ ID NO: 2000 - RNA, 22 nt, Artificial Sequence
  Guide Sequence
ccggacuuaagaccaaaacagu

SEQ ID NO: 2001 - RNA, 22 nt, Artificial Sequence
  Guide Sequence
cggacuuaagaccaaaacagug

SEQ ID NO: 2002 - RNA, 22 nt, Artificial Sequence
  Guide Sequence
cggggacuuucagcuucccgga

SEQ ID NO: 2003 - RNA, 22 nt, Artificial Sequence
  Guide Sequence
cuguuuuggucuuaaguccggg

SEQ ID NO: 2004 - RNA, 22 nt, Artificial Sequence
  Guide Sequence
cuuaagaccaaaacagugggaa

SEQ ID NO: 2005 - RNA, 22 nt, Artificial Sequence
  Guide Sequence
cuuaaguccgggaagcugaaag

SEQ ID NO: 2006 - RNA, 22 nt, Artificial Sequence
  Guide Sequence
cuucccggacuuaagaccaaaa

SEQ ID NO: 2007 - RNA, 22 nt, Artificial Sequence
  Guide Sequence
cuuucagcuucccggacuuaag

SEQ ID NO: 2008 - RNA, 22 nt, Artificial Sequence
  Guide Sequence
cuuuucccacuguuuuggucuu

SEQ ID NO: 2009 - RNA, 22 nt, Artificial Sequence
  Guide Sequence
gacuuaagaccaaaacaguggg

SEQ ID NO: 2010 - RNA, 22 nt, Artificial Sequence
  Guide Sequence
gacuuucagcuucccggacuua

SEQ ID NO: 2011 - RNA, 22 nt, Artificial Sequence
  Guide Sequence
gcuucccggacuuaagaccaaa

SEQ ID NO: 2012 - RNA, 22 nt, Artificial Sequence
  Guide Sequence
gcuuuucccacuguuuuggucu

SEQ ID NO: 2013 - RNA, 22 nt, Artificial Sequence
  Guide Sequence
ggacuuaagaccaaaacagugg

SEQ ID NO: 2014 - RNA, 22 nt, Artificial Sequence
  Guide Sequence
ggacuuucagcuucccggacuu

SEQ ID NO: 2015 - RNA, 22 nt, Artificial Sequence
  Guide Sequence
gggacuuucagcuucccggacu

SEQ ID NO: 2016 - RNA, 22 nt, Artificial Sequence
  Guide Sequence
ggggacuuucagcuucccggac

SEQ ID NO: 2017 - RNA, 22 nt, Artificial Sequence
  Guide Sequence
ggucuuaaguccgggaagcuga

SEQ ID NO: 2018 - RNA, 22 nt, Artificial Sequence
  Guide Sequence
gucuuaaguccgggaagcugaa

SEQ ID NO: 2019 - RNA, 22 nt, Artificial Sequence
  Guide Sequence
guuuuggucuuaaguccgggaa

SEQ ID NO: 2020 - RNA, 22 nt, Artificial Sequence
  Guide Sequence
uaaguccgggaagcugaaaguc

SEQ ID NO: 2021 - RNA, 22 nt, Artificial Sequence
  Guide Sequence
ucagcuucccggacuuaagacc

SEQ ID NO: 2022 - RNA, 22 nt, Artificial Sequence
  Guide Sequence
ucccacuguuuuggucuuaagu

SEQ ID NO: 2023 - RNA, 22 nt, Artificial Sequence
  Guide Sequence
ucccggacuuaagaccaaaaca

SEQ ID NO: 2024 - RNA, 22 nt, Artificial Sequence
  Guide Sequence
ucggggacuuucagcuucccgg

SEQ ID NO: 2025 - RNA, 22 nt, Artificial Sequence
  Guide Sequence
ucuuaaguccgggaagcugaaa

SEQ ID NO: 2026 - RNA, 22 nt, Artificial Sequence
  Guide Sequence
ugcuuuucccacuguuuugguc

SEQ ID NO: 2027 - RNA, 22 nt, Artificial Sequence
  Guide Sequence
uggucuuaaguccgggaagcug

SEQ ID NO: 2028 - RNA, 22 nt, Artificial Sequence
  Guide Sequence
uguuuuggucuuaaguccggga

SEQ ID NO: 2029 - RNA, 22 nt, Artificial Sequence
  Guide Sequence
uuaaguccgggaagcugaaagu

SEQ ID NO: 2030 - RNA, 22 nt, Artificial Sequence
  Guide Sequence
uucagcuucccggacuuaagac

SEQ ID NO: 2031 - RNA, 22 nt, Artificial Sequence
  Guide Sequence
uucccacuguuuuggucuuaag

SEQ ID NO: 2032 - RNA, 22 nt, Artificial Sequence
  Guide Sequence
uucccggacuuaagaccaaaac

SEQ ID NO: 2033 - RNA, 22 nt, Artificial Sequence
  Guide Sequence
uucggggacuuucagcuucccg

SEQ ID NO: 2034 - RNA, 22 nt, Artificial Sequence
  Guide Sequence
uuggucuuaaguccgggaagcu

SEQ ID NO: 2035 - RNA, 22 nt, Artificial Sequence
  Guide Sequence
uuucagcuucccggacuuaaga

SEQ ID NO: 2036 - RNA, 22 nt, Artificial Sequence
  Guide Sequence
uuucccacuguuuuggucuuaa

SEQ ID NO: 2037 - RNA, 22 nt, Artificial Sequence
  Guide Sequence
uuuggucuuaaguccgggaagc

SEQ ID NO: 2038 - RNA, 22 nt, Artificial Sequence
  Guide Sequence
uuuucccacuguuuuggucuua

SEQ ID NO: 2039 - RNA, 22 nt, Artificial Sequence
  Guide Sequence
uuuuggucuuaaguccgggaag

SEQ ID NO: 2040 - RNA, 20 nt, Artificial Sequence
  Guide Sequence
aaaguccccgaauaggugga

SEQ ID NO: 2041 - RNA, 20 nt, Artificial Sequence
  Guide Sequence
aagcugaaaguccccgaaua

SEQ ID NO: 2042 - RNA, 20 nt, Artificial Sequence
  Guide Sequence
aaguccccgaauagguggau

SEQ ID NO: 2043 - RNA, 20 nt, Artificial Sequence
  Guide Sequence
aauagguggauaccgucaag

SEQ ID NO: 2044 - RNA, 20 nt, Artificial Sequence
  Guide Sequence
accuauucggggacuuucag

SEQ ID NO: 2045 - RNA, 20 nt, Artificial Sequence
  Guide Sequence
acgguauccaccuauucggg

SEQ ID NO: 2046 - RNA, 20 nt, Artificial Sequence
  Guide Sequence
agcugaaaguccccgaauag

SEQ ID NO: 2047 - RNA, 20 nt, Artificial Sequence
  Guide Sequence
agcuugacgguauccaccua

SEQ ID NO: 2048 - RNA, 20 nt, Artificial Sequence
  Guide Sequence
aguccccgaauagguggaua

SEQ ID NO: 2049 - RNA, 20 nt, Artificial Sequence
  Guide Sequence
auagguggauaccgucaagc

SEQ ID NO: 2050 - RNA, 20 nt, Artificial Sequence
  Guide Sequence
auccaccuauucggggacuu

SEQ ID NO: 2051 - RNA, 20 nt, Artificial Sequence
  Guide Sequence
caccuauucggggacuuuca

SEQ ID NO: 2052 - RNA, 20 nt, Artificial Sequence
  Guide Sequence
cagcuugacgguauccaccu

SEQ ID NO: 2053 - RNA, 20 nt, Artificial Sequence
  Guide Sequence
ccaccuauucggggacuuuc

SEQ ID NO: 2054 - RNA, 20 nt, Artificial Sequence
  Guide Sequence
ccagcuugacgguauccacc

SEQ ID NO: 2055 - RNA, 20 nt, Artificial Sequence
  Guide Sequence
ccccgaauagguggauaccg

SEQ ID NO: 2056 - RNA, 20 nt, Artificial Sequence
  Guide Sequence
cccgaauagguggauaccgu

SEQ ID NO: 2057 - RNA, 20 nt, Artificial Sequence
  Guide Sequence
ccgaauagguggauaccguc

SEQ ID NO: 2058 - RNA, 20 nt, Artificial Sequence
  Guide Sequence
ccuauucggggacuuucagc

SEQ ID NO: 2059 - RNA, 20 nt, Artificial Sequence
  Guide Sequence
cgaauagguggauaccguca

SEQ ID NO: 2060 - RNA, 20 nt, Artificial Sequence
  Guide Sequence
cgggaagcugaaaguccccg

SEQ ID NO: 2061 - RNA, 20 nt, Artificial Sequence
  Guide Sequence
cgguauccaccuauucgggg

SEQ ID NO: 2062 - RNA, 20 nt, Artificial Sequence
  Guide Sequence
cuauucggggacuuucagcu

SEQ ID NO: 2063 - RNA, 20 nt, Artificial Sequence
  Guide Sequence
cugaaaguccccgaauaggu

SEQ ID NO: 2064 - RNA, 20 nt, Artificial Sequence
  Guide Sequence
cuugacgguauccaccuauu

SEQ ID NO: 2065 - RNA, 20 nt, Artificial Sequence
  Guide Sequence
gaaaguccccgaauaggugg

SEQ ID NO: 2066 - RNA, 20 nt, Artificial Sequence
  Guide Sequence
gaagcugaaaguccccgaau

SEQ ID NO: 2067 - RNA, 20 nt, Artificial Sequence
  Guide Sequence
gaauagguggauaccgucaa

SEQ ID NO: 2068 - RNA, 20 nt, Artificial Sequence
  Guide Sequence
gacgguauccaccuauucgg

SEQ ID NO: 2069 - RNA, 20 nt, Artificial Sequence
  Guide Sequence
gccagcuugacgguauccac

SEQ ID NO: 2070 - RNA, 20 nt, Artificial Sequence
  Guide Sequence
gcugaaaguccccgaauagg

SEQ ID NO: 2071 - RNA, 20 nt, Artificial Sequence
  Guide Sequence
gcuugacgguauccaccuau

SEQ ID NO: 2072 - RNA, 20 nt, Artificial Sequence
  Guide Sequence
ggaagcugaaaguccccgaa

SEQ ID NO: 2073 - RNA, 20 nt, Artificial Sequence
  Guide Sequence
ggccagcuugacgguaucca

SEQ ID NO: 2074 - RNA, 20 nt, Artificial Sequence
  Guide Sequence
gggaagcugaaaguccccga

SEQ ID NO: 2075 - RNA, 20 nt, Artificial Sequence
  Guide Sequence
gguauccaccuauucgggga

SEQ ID NO: 2076 - RNA, 20 nt, Artificial Sequence
  Guide Sequence
guauccaccuauucggggac

SEQ ID NO: 2077 - RNA, 20 nt, Artificial Sequence
  Guide Sequence
guccccgaauagguggauac

SEQ ID NO: 2078 - RNA, 20 nt, Artificial Sequence
  Guide Sequence
uagguggauaccgucaagcu

SEQ ID NO: 2079 - RNA, 20 nt, Artificial Sequence
  Guide Sequence
uauccaccuauucggggacu

SEQ ID NO: 2080 - RNA, 20 nt, Artificial Sequence
  Guide Sequence
uccaccuauucggggacuuu

SEQ ID NO: 2081 - RNA, 20 nt, Artificial Sequence
  Guide Sequence
uccccgaauagguggauacc

SEQ ID NO: 2082 - RNA, 20 nt, Artificial Sequence
  Guide Sequence
ugaaaguccccgaauaggug

SEQ ID NO: 2083 - RNA, 20 nt, Artificial Sequence
  Guide Sequence
ugacgguauccaccuauucg

SEQ ID NO: 2084 - RNA, 20 nt, Artificial Sequence
  Guide Sequence
uggccagcuugacgguaucc

SEQ ID NO: 2085 - RNA, 20 nt, Artificial Sequence
  Guide Sequence
uugacgguauccaccuauuc

SEQ ID NO: 2086 - RNA, 21 nt, Artificial Sequence
  Guide Sequence
aaaguccccgaauagguggau

SEQ ID NO: 2087 - RNA, 21 nt, Artificial Sequence
  Guide Sequence
aagcugaaaguccccgaauag

SEQ ID NO: 2088 - RNA, 21 nt, Artificial Sequence
  Guide Sequence
aaguccccgaauagguggaua

SEQ ID NO: 2089 - RNA, 21 nt, Artificial Sequence
  Guide Sequence
aauagguggauaccgucaagc

SEQ ID NO: 2090 - RNA, 21 nt, Artificial Sequence
  Guide Sequence
accuauucggggacuuucagc

SEQ ID NO: 2091 - RNA, 21 nt, Artificial Sequence
  Guide Sequence
acgguauccaccuauucgggg

SEQ ID NO: 2092 - RNA, 21 nt, Artificial Sequence
  Guide Sequence
agcugaaaguccccgaauagg

SEQ ID NO: 2093 - RNA, 21 nt, Artificial Sequence
  Guide Sequence
agcuugacgguauccaccuau

SEQ ID NO: 2094 - RNA, 21 nt, Artificial Sequence
  Guide Sequence
aguccccgaauagguggauac

SEQ ID NO: 2095 - RNA, 21 nt, Artificial Sequence
  Guide Sequence
auagguggauaccgucaagcu

SEQ ID NO: 2096 - RNA, 21 nt, Artificial Sequence
  Guide Sequence
auccaccuauucggggacuuu

SEQ ID NO: 2097 - RNA, 21 nt, Artificial Sequence
  Guide Sequence
caccuauucggggacuuucag

SEQ ID NO: 2098 - RNA, 21 nt, Artificial Sequence
  Guide Sequence
cagcuugacgguauccaccua

SEQ ID NO: 2099 - RNA, 21 nt, Artificial Sequence
  Guide Sequence
ccaccuauucggggacuuuca

SEQ ID NO: 2100 - RNA, 21 nt, Artificial Sequence
  Guide Sequence
ccagcuugacgguauccaccu

SEQ ID NO: 2101 - RNA, 21 nt, Artificial Sequence
  Guide Sequence
ccccgaauagguggauaccgu

SEQ ID NO: 2102 - RNA, 21 nt, Artificial Sequence
  Guide Sequence
cccgaauagguggauaccguc

SEQ ID NO: 2103 - RNA, 21 nt, Artificial Sequence
  Guide Sequence
ccgaauagguggauaccguca

SEQ ID NO: 2104 - RNA, 21 nt, Artificial Sequence
  Guide Sequence
ccgggaagcugaaaguccccg

SEQ ID NO: 2105 - RNA, 21 nt, Artificial Sequence
  Guide Sequence
ccuauucggggacuuucagcu

SEQ ID NO: 2106 - RNA, 21 nt, Artificial Sequence
  Guide Sequence
cgaauagguggauaccgucaa

SEQ ID NO: 2107 - RNA, 21 nt, Artificial Sequence
  Guide Sequence
cgggaagcugaaaguccccga

SEQ ID NO: 2108 - RNA, 21 nt, Artificial Sequence
  Guide Sequence
cgguauccaccuauucgggga

SEQ ID NO: 2109 - RNA, 21 nt, Artificial Sequence
  Guide Sequence
cuauucggggacuuucagcuu

SEQ ID NO: 2110 - RNA, 21 nt, Artificial Sequence
  Guide Sequence
cugaaaguccccgaauaggug

SEQ ID NO: 2111 - RNA, 21 nt, Artificial Sequence
  Guide Sequence
cuugacgguauccaccuauuc

SEQ ID NO: 2112 - RNA, 21 nt, Artificial Sequence
  Guide Sequence
gaaaguccccgaauaggugga

SEQ ID NO: 2113 - RNA, 21 nt, Artificial Sequence
  Guide Sequence
gaagcugaaaguccccgaaua

SEQ ID NO: 2114 - RNA, 21 nt, Artificial Sequence
  Guide Sequence
gaauagguggauaccgucaag

SEQ ID NO: 2115 - RNA, 21 nt, Artificial Sequence
  Guide Sequence
gacgguauccaccuauucggg

SEQ ID NO: 2116 - RNA, 21 nt, Artificial Sequence
  Guide Sequence
gccagcuugacgguauccacc

SEQ ID NO: 2117 - RNA, 21 nt, Artificial Sequence
  Guide Sequence
gcugaaaguccccgaauaggu

SEQ ID NO: 2118 - RNA, 21 nt, Artificial Sequence
  Guide Sequence
gcuugacgguauccaccuauu

SEQ ID NO: 2119 - RNA, 21 nt, Artificial Sequence
  Guide Sequence
ggaagcugaaaguccccgaau

SEQ ID NO: 2120 - RNA, 21 nt, Artificial Sequence
  Guide Sequence
ggccagcuugacgguauccac

SEQ ID NO: 2121 - RNA, 21 nt, Artificial Sequence
  Guide Sequence
gggaagcugaaaguccccgaa

SEQ ID NO: 2122 - RNA, 21 nt, Artificial Sequence
  Guide Sequence
gguauccaccuauucggggac

SEQ ID NO: 2123 - RNA, 21 nt, Artificial Sequence
  Guide Sequence
guauccaccuauucggggacu

SEQ ID NO: 2124 - RNA, 21 nt, Artificial Sequence
  Guide Sequence
guccccgaauagguggauacc

SEQ ID NO: 2125 - RNA, 21 nt, Artificial Sequence
  Guide Sequence
uagguggauaccgucaagcug

SEQ ID NO: 2126 - RNA, 21 nt, Artificial Sequence
  Guide Sequence
uauccaccuauucggggacuu

SEQ ID NO: 2127 - RNA, 21 nt, Artificial Sequence
  Guide Sequence
uccaccuauucggggacuuuc

SEQ ID NO: 2128 - RNA, 21 nt, Artificial Sequence
  Guide Sequence
uccccgaauagguggauaccg

SEQ ID NO: 2129 - RNA, 21 nt, Artificial Sequence
  Guide Sequence
ugaaaguccccgaauaggugg

SEQ ID NO: 2130 - RNA, 21 nt, Artificial Sequence
  Guide Sequence
ugacgguauccaccuauucgg

SEQ ID NO: 2131 - RNA, 21 nt, Artificial Sequence
  Guide Sequence
uggccagcuugacgguaucca

SEQ ID NO: 2132 - RNA, 21 nt, Artificial Sequence
  Guide Sequence
uugacgguauccaccuauucg

SEQ ID NO: 2133 - RNA, 21 nt, Artificial Sequence
  Guide Sequence
uuggccagcuugacgguaucc

SEQ ID NO: 2134 - RNA, 22 nt, Artificial Sequence
  Guide Sequence
aaaguccccgaauagguggaua

SEQ ID NO: 2135 - RNA, 22 nt, Artificial Sequence
  Guide Sequence
aagcugaaaguccccgaauagg

SEQ ID NO: 2136 - RNA, 22 nt, Artificial Sequence
  Guide Sequence
aaguccccgaauagguggauac

SEQ ID NO: 2137 - RNA, 22 nt, Artificial Sequence
  Guide Sequence
aauagguggauaccgucaagcu

SEQ ID NO: 2138 - RNA, 22 nt, Artificial Sequence
  Guide Sequence
accuauucggggacuuucagcu

SEQ ID NO: 2139 - RNA, 22 nt, Artificial Sequence
  Guide Sequence
acgguauccaccuauucgggga

SEQ ID NO: 2140 - RNA, 22 nt, Artificial Sequence
  Guide Sequence
agcugaaaguccccgaauaggu

SEQ ID NO: 2141 - RNA, 22 nt, Artificial Sequence
  Guide Sequence
agcuugacgguauccaccuauu

SEQ ID NO: 2142 - RNA, 22 nt, Artificial Sequence
  Guide Sequence
aguccccgaauagguggauacc

SEQ ID NO: 2143 - RNA, 22 nt, Artificial Sequence
  Guide Sequence
auagguggauaccgucaagcug

SEQ ID NO: 2144 - RNA, 22 nt, Artificial Sequence
  Guide Sequence
auccaccuauucggggacuuuc

SEQ ID NO: 2145 - RNA, 22 nt, Artificial Sequence
  Guide Sequence
caccuauucggggacuuucagc

SEQ ID NO: 2146 - RNA, 22 nt, Artificial Sequence
  Guide Sequence
cagcuugacgguauccaccuau

SEQ ID NO: 2147 - RNA, 22 nt, Artificial Sequence
  Guide Sequence
ccaccuauucggggacuuucag

SEQ ID NO: 2148 - RNA, 22 nt, Artificial Sequence
  Guide Sequence
ccagcuugacgguauccaccua

SEQ ID NO: 2149 - RNA, 22 nt, Artificial Sequence
  Guide Sequence
ccccgaauagguggauaccguc

SEQ ID NO: 2150 - RNA, 22 nt, Artificial Sequence
  Guide Sequence
cccgaauagguggauaccguca

SEQ ID NO: 2151 - RNA, 22 nt, Artificial Sequence
  Guide Sequence
ccgaauagguggauaccgucaa

SEQ ID NO: 2152 - RNA, 22 nt, Artificial Sequence
  Guide Sequence
ccgggaagcugaaaguccccga

SEQ ID NO: 2153 - RNA, 22 nt, Artificial Sequence
  Guide Sequence
ccuauucggggacuuucagcuu

SEQ ID NO: 2154 - RNA, 22 nt, Artificial Sequence
  Guide Sequence
cgaauagguggauaccgucaag

SEQ ID NO: 2155 - RNA, 22 nt, Artificial Sequence
  Guide Sequence
cgggaagcugaaaguccccgaa

SEQ ID NO: 2156 - RNA, 22 nt, Artificial Sequence
  Guide Sequence
cgguauccaccuauucggggac

SEQ ID NO: 2157 - RNA, 22 nt, Artificial Sequence
  Guide Sequence
cuauucggggacuuucagcuuc

SEQ ID NO: 2158 - RNA, 22 nt, Artificial Sequence
  Guide Sequence
cugaaaguccccgaauaggugg

SEQ ID NO: 2159 - RNA, 22 nt, Artificial Sequence
  Guide Sequence
cuugacgguauccaccuauucg

SEQ ID NO: 2160 - RNA, 22 nt, Artificial Sequence
  Guide Sequence
cuuggccagcuugacgguaucc

SEQ ID NO: 2161 - RNA, 22 nt, Artificial Sequence
  Guide Sequence
gaaaguccccgaauagguggau

SEQ ID NO: 2162 - RNA, 22 nt, Artificial Sequence
  Guide Sequence
gaagcugaaaguccccgaauag

SEQ ID NO: 2163 - RNA, 22 nt, Artificial Sequence
  Guide Sequence
gaauagguggauaccgucaagc

SEQ ID NO: 2164 - RNA, 22 nt, Artificial Sequence
  Guide Sequence
gacgguauccaccuauucgggg

SEQ ID NO: 2165 - RNA, 22 nt, Artificial Sequence
  Guide Sequence
gccagcuugacgguauccaccu

SEQ ID NO: 2166 - RNA, 22 nt, Artificial Sequence
  Guide Sequence
gcugaaaguccccgaauaggug

SEQ ID NO: 2167 - RNA, 22 nt, Artificial Sequence
  Guide Sequence
gcuugacgguauccaccuauuc

SEQ ID NO: 2168 - RNA, 22 nt, Artificial Sequence
  Guide Sequence
ggaagcugaaaguccccgaaua

SEQ ID NO: 2169 - RNA, 22 nt, Artificial Sequence
  Guide Sequence
ggccagcuugacgguauccacc

SEQ ID NO: 2170 - RNA, 22 nt, Artificial Sequence
  Guide Sequence
gggaagcugaaaguccccgaau

SEQ ID NO: 2171 - RNA, 22 nt, Artificial Sequence
  Guide Sequence
gguauccaccuauucggggacu

SEQ ID NO: 2172 - RNA, 22 nt, Artificial Sequence
  Guide Sequence
guauccaccuauucggggacuu

SEQ ID NO: 2173 - RNA, 22 nt, Artificial Sequence
  Guide Sequence
guccccgaauagguggauaccg

SEQ ID NO: 2174 - RNA, 22 nt, Artificial Sequence
  Guide Sequence
uagguggauaccgucaagcugg

SEQ ID NO: 2175 - RNA, 22 nt, Artificial Sequence
  Guide Sequence
uauccaccuauucggggacuuu

SEQ ID NO: 2176 - RNA, 22 nt, Artificial Sequence
  Guide Sequence
uccaccuauucggggacuuuca

SEQ ID NO: 2177 - RNA, 22 nt, Artificial Sequence
  Guide Sequence
uccccgaauagguggauaccgu

SEQ ID NO: 2178 - RNA, 22 nt, Artificial Sequence
  Guide Sequence
uccgggaagcugaaaguccccg

SEQ ID NO: 2179 - RNA, 22 nt, Artificial Sequence
  Guide Sequence
ugaaaguccccgaauaggugga

SEQ ID NO: 2180 - RNA, 22 nt, Artificial Sequence
  Guide Sequence
ugacgguauccaccuauucggg

SEQ ID NO: 2181 - RNA, 22 nt, Artificial Sequence
  Guide Sequence
uggccagcuugacgguauccac

SEQ ID NO: 2182 - RNA, 22 nt, Artificial Sequence
  Guide Sequence
uugacgguauccaccuauucgg

SEQ ID NO: 2183 - RNA, 22 nt, Artificial Sequence
  Guide Sequence
uuggccagcuugacgguaucca

SEQ ID NO: 2184 - RNA, 20 nt, Artificial Sequence
  Guide Sequence
aaaguccccgaaugggugga

SEQ ID NO: 2185 - RNA, 20 nt, Artificial Sequence
  Guide Sequence
aaguccccgaauggguggaa

SEQ ID NO: 2186 - RNA, 20 nt, Artificial Sequence
  Guide Sequence
aauaccgucaagcuggccaa

SEQ ID NO: 2187 - RNA, 20 nt, Artificial Sequence
  Guide Sequence
aauggguggaauaccgucaa

SEQ ID NO: 2188 - RNA, 20 nt, Artificial Sequence
  Guide Sequence
acgguauuccacccauucgg

SEQ ID NO: 2189 - RNA, 20 nt, Artificial Sequence
  Guide Sequence
agcuugacgguauuccaccc

SEQ ID NO: 2190 - RNA, 20 nt, Artificial Sequence
  Guide Sequence
aguccccgaauggguggaau

SEQ ID NO: 2191 - RNA, 20 nt, Artificial Sequence
  Guide Sequence
auggguggaauaccgucaag

SEQ ID NO: 2192 - RNA, 20 nt, Artificial Sequence
  Guide Sequence
auuccacccauucggggacu

SEQ ID NO: 2193 - RNA, 20 nt, Artificial Sequence
  Guide Sequence
cagcuugacgguauuccacc

SEQ ID NO: 2194 - RNA, 20 nt, Artificial Sequence
  Guide Sequence
ccagcuugacgguauuccac

SEQ ID NO: 2195 - RNA, 20 nt, Artificial Sequence
  Guide Sequence
ccccgaauggguggaauacc

SEQ ID NO: 2196 - RNA, 20 nt, Artificial Sequence
  Guide Sequence
cccgaauggguggaauaccg

SEQ ID NO: 2197 - RNA, 20 nt, Artificial Sequence
  Guide Sequence
ccgaauggguggaauaccgu

SEQ ID NO: 2198 - RNA, 20 nt, Artificial Sequence
  Guide Sequence
cgaauggguggaauaccguc

SEQ ID NO: 2199 - RNA, 20 nt, Artificial Sequence
  Guide Sequence
cgguauuccacccauucggg

SEQ ID NO: 2200 - RNA, 20 nt, Artificial Sequence
  Guide Sequence
cugaaaguccccgaaugggu

SEQ ID NO: 2201 - RNA, 20 nt, Artificial Sequence
  Guide Sequence
cuugacgguauuccacccau

SEQ ID NO: 2202 - RNA, 20 nt, Artificial Sequence
  Guide Sequence
cuuggccagcuugacgguau

SEQ ID NO: 2203 - RNA, 20 nt, Artificial Sequence
  Guide Sequence
gaaaguccccgaaugggugg

SEQ ID NO: 2204 - RNA, 20 nt, Artificial Sequence
  Guide Sequence
gaauaccgucaagcuggcca

SEQ ID NO: 2205 - RNA, 20 nt, Artificial Sequence
  Guide Sequence
gaauggguggaauaccguca

SEQ ID NO: 2206 - RNA, 20 nt, Artificial Sequence
  Guide Sequence
gacgguauuccacccauucg

SEQ ID NO: 2207 - RNA, 20 nt, Artificial Sequence
  Guide Sequence
gccagcuugacgguauucca

SEQ ID NO: 2208 - RNA, 20 nt, Artificial Sequence
  Guide Sequence
gcuugacgguauuccaccca

SEQ ID NO: 2209 - RNA, 20 nt, Artificial Sequence
  Guide Sequence
gcuuggccagcuugacggua

SEQ ID NO: 2210 - RNA, 20 nt, Artificial Sequence
  Guide Sequence
ggaauaccgucaagcuggcc

SEQ ID NO: 2211 - RNA, 20 nt, Artificial Sequence
  Guide Sequence
ggccagcuugacgguauucc

SEQ ID NO: 2212 - RNA, 20 nt, Artificial Sequence
  Guide Sequence
ggguggaauaccgucaagcu

SEQ ID NO: 2213 - RNA, 20 nt, Artificial Sequence
  Guide Sequence
gguauuccacccauucgggg

SEQ ID NO: 2214 - RNA, 20 nt, Artificial Sequence
  Guide Sequence
gguggaauaccgucaagcug

SEQ ID NO: 2215 - RNA, 20 nt, Artificial Sequence
  Guide Sequence
guauuccacccauucgggga

SEQ ID NO: 2216 - RNA, 20 nt, Artificial Sequence
  Guide Sequence
guccccgaauggguggaaua

SEQ ID NO: 2217 - RNA, 20 nt, Artificial Sequence
  Guide Sequence
gugcuuggccagcuugacgg

SEQ ID NO: 2218 - RNA, 20 nt, Artificial Sequence
  Guide Sequence
guggaauaccgucaagcugg

SEQ ID NO: 2219 - RNA, 20 nt, Artificial Sequence
  Guide Sequence
uaccgucaagcuggccaagc

SEQ ID NO: 2220 - RNA, 20 nt, Artificial Sequence
  Guide Sequence
uauuccacccauucggggac

SEQ ID NO: 2221 - RNA, 20 nt, Artificial Sequence
  Guide Sequence
uccccgaauggguggaauac

SEQ ID NO: 2222 - RNA, 20 nt, Artificial Sequence
  Guide Sequence
ugaaaguccccgaaugggug

SEQ ID NO: 2223 - RNA, 20 nt, Artificial Sequence
  Guide Sequence
ugacgguauuccacccauuc

SEQ ID NO: 2224 - RNA, 20 nt, Artificial Sequence
  Guide Sequence
ugcuuggccagcuugacggu

SEQ ID NO: 2225 - RNA, 20 nt, Artificial Sequence
  Guide Sequence
uggaauaccgucaagcuggc

SEQ ID NO: 2226 - RNA, 20 nt, Artificial Sequence
  Guide Sequence
uggccagcuugacgguauuc

SEQ ID NO: 2227 - RNA, 20 nt, Artificial Sequence
  Guide Sequence
uggguggaauaccgucaagc

SEQ ID NO: 2228 - RNA, 20 nt, Artificial Sequence
  Guide Sequence
ugugcuuggccagcuugacg

SEQ ID NO: 2229 - RNA, 20 nt, Artificial Sequence
  Guide Sequence
uugacgguauuccacccauu

SEQ ID NO: 2230 - RNA, 20 nt, Artificial Sequence
  Guide Sequence
uuggccagcuugacgguauu

SEQ ID NO: 2231 - RNA, 20 nt, Artificial Sequence
  Guide Sequence
uugugcuuggccagcuugac

SEQ ID NO: 2232 - RNA, 21 nt, Artificial Sequence
  Guide Sequence
aaaguccccgaauggguggaa

SEQ ID NO: 2233 - RNA, 21 nt, Artificial Sequence
  Guide Sequence
aaguccccgaauggguggaau

SEQ ID NO: 2234 - RNA, 21 nt, Artificial Sequence
  Guide Sequence
aauaccgucaagcuggccaag

SEQ ID NO: 2235 - RNA, 21 nt, Artificial Sequence
  Guide Sequence
aauggguggaauaccgucaag

SEQ ID NO: 2236 - RNA, 21 nt, Artificial Sequence
  Guide Sequence
acgguauuccacccauucggg

SEQ ID NO: 2237 - RNA, 21 nt, Artificial Sequence
  Guide Sequence
agcuugacgguauuccaccca

SEQ ID NO: 2238 - RNA, 21 nt, Artificial Sequence
  Guide Sequence
aguccccgaauggguggaaua

SEQ ID NO: 2239 - RNA, 21 nt, Artificial Sequence
  Guide Sequence
auggguggaauaccgucaagc

SEQ ID NO: 2240 - RNA, 21 nt, Artificial Sequence
  Guide Sequence
auuccacccauucggggacuu

SEQ ID NO: 2241 - RNA, 21 nt, Artificial Sequence
  Guide Sequence
cagcuugacgguauuccaccc

SEQ ID NO: 2242 - RNA, 21 nt, Artificial Sequence
  Guide Sequence
ccagcuugacgguauuccacc

SEQ ID NO: 2243 - RNA, 21 nt, Artificial Sequence
  Guide Sequence
ccccgaauggguggaauaccg

SEQ ID NO: 2244 - RNA, 21 nt, Artificial Sequence
  Guide Sequence
cccgaauggguggaauaccgu

SEQ ID NO: 2245 - RNA, 21 nt, Artificial Sequence
  Guide Sequence
ccgaauggguggaauaccguc

SEQ ID NO: 2246 - RNA, 21 nt, Artificial Sequence
  Guide Sequence
cgaauggguggaauaccguca

SEQ ID NO: 2247 - RNA, 21 nt, Artificial Sequence
  Guide Sequence
cgguauuccacccauucgggg

SEQ ID NO: 2248 - RNA, 21 nt, Artificial Sequence
  Guide Sequence
cugaaaguccccgaaugggug

SEQ ID NO: 2249 - RNA, 21 nt, Artificial Sequence
  Guide Sequence
cuugacgguauuccacccauu

SEQ ID NO: 2250 - RNA, 21 nt, Artificial Sequence
  Guide Sequence
cuuggccagcuugacgguauu

SEQ ID NO: 2251 - RNA, 21 nt, Artificial Sequence
  Guide Sequence
gaaaguccccgaaugggugga

SEQ ID NO: 2252 - RNA, 21 nt, Artificial Sequence
  Guide Sequence
gaauaccgucaagcuggccaa

SEQ ID NO: 2253 - RNA, 21 nt, Artificial Sequence
  Guide Sequence
gaauggguggaauaccgucaa

SEQ ID NO: 2254 - RNA, 21 nt, Artificial Sequence
  Guide Sequence
gacgguauuccacccauucgg

SEQ ID NO: 2255 - RNA, 21 nt, Artificial Sequence
  Guide Sequence
gccagcuugacgguauuccac

SEQ ID NO: 2256 - RNA, 21 nt, Artificial Sequence
  Guide Sequence
gcugaaaguccccgaaugggu

SEQ ID NO: 2257 - RNA, 21 nt, Artificial Sequence
  Guide Sequence
gcuugacgguauuccacccau

SEQ ID NO: 2258 - RNA, 21 nt, Artificial Sequence
  Guide Sequence
gcuuggccagcuugacgguau

SEQ ID NO: 2259 - RNA, 21 nt, Artificial Sequence
  Guide Sequence
ggaauaccgucaagcuggcca

SEQ ID NO: 2260 - RNA, 21 nt, Artificial Sequence
  Guide Sequence
ggccagcuugacgguauucca

SEQ ID NO: 2261 - RNA, 21 nt, Artificial Sequence
  Guide Sequence
ggguggaauaccgucaagcug

SEQ ID NO: 2262 - RNA, 21 nt, Artificial Sequence
  Guide Sequence
gguauuccacccauucgggga

SEQ ID NO: 2263 - RNA, 21 nt, Artificial Sequence
  Guide Sequence
gguggaauaccgucaagcugg

SEQ ID NO: 2264 - RNA, 21 nt, Artificial Sequence
  Guide Sequence
guauuccacccauucggggac

SEQ ID NO: 2265 - RNA, 21 nt, Artificial Sequence
  Guide Sequence
guccccgaauggguggaauac

SEQ ID NO: 2266 - RNA, 21 nt, Artificial Sequence
  Guide Sequence
gugcuuggccagcuugacggu

SEQ ID NO: 2267 - RNA, 21 nt, Artificial Sequence
  Guide Sequence
guggaauaccgucaagcuggc

SEQ ID NO: 2268 - RNA, 21 nt, Artificial Sequence
  Guide Sequence
uaccgucaagcuggccaagca

SEQ ID NO: 2269 - RNA, 21 nt, Artificial Sequence
  Guide Sequence
uauuccacccauucggggacu

SEQ ID NO: 2270 - RNA, 21 nt, Artificial Sequence
  Guide Sequence
uccccgaauggguggaauacc

SEQ ID NO: 2271 - RNA, 21 nt, Artificial Sequence
  Guide Sequence
ugaaaguccccgaaugggugg

SEQ ID NO: 2272 - RNA, 21 nt, Artificial Sequence
  Guide Sequence
ugacgguauuccacccauucg

SEQ ID NO: 2273 - RNA, 21 nt, Artificial Sequence
  Guide Sequence
ugcuuggccagcuugacggua

SEQ ID NO: 2274 - RNA, 21 nt, Artificial Sequence
  Guide Sequence
uggaauaccgucaagcuggcc

SEQ ID NO: 2275 - RNA, 21 nt, Artificial Sequence
  Guide Sequence
uggccagcuugacgguauucc

SEQ ID NO: 2276 - RNA, 21 nt, Artificial Sequence
  Guide Sequence
uggguggaauaccgucaagcu

SEQ ID NO: 2277 - RNA, 21 nt, Artificial Sequence
  Guide Sequence
ugugcuuggccagcuugacgg

SEQ ID NO: 2278 - RNA, 21 nt, Artificial Sequence
  Guide Sequence
uugacgguauuccacccauuc

SEQ ID NO: 2279 - RNA, 21 nt, Artificial Sequence
  Guide Sequence
uuggccagcuugacgguauuc

SEQ ID NO: 2280 - RNA, 21 nt, Artificial Sequence
  Guide Sequence
uugugcuuggccagcuugacg

SEQ ID NO: 2281 - RNA, 21 nt, Artificial Sequence
  Guide Sequence
uuugugcuuggccagcuugac

SEQ ID NO: 2282 - RNA, 22 nt, Artificial Sequence
  Guide Sequence
aaaguccccgaauggguggaau

SEQ ID NO: 2283 - RNA, 22 nt, Artificial Sequence
  Guide Sequence
aaguccccgaauggguggaaua

SEQ ID NO: 2284 - RNA, 22 nt, Artificial Sequence
  Guide Sequence
aauaccgucaagcuggccaagc

SEQ ID NO: 2285 - RNA, 22 nt, Artificial Sequence
  Guide Sequence
aauggguggaauaccgucaagc

SEQ ID NO: 2286 - RNA, 22 nt, Artificial Sequence
  Guide Sequence
acgguauuccacccauucgggg

SEQ ID NO: 2287 - RNA, 22 nt, Artificial Sequence
  Guide Sequence
agcugaaaguccccgaaugggu

SEQ ID NO: 2288 - RNA, 22 nt, Artificial Sequence
  Guide Sequence
agcuugacgguauuccacccau

SEQ ID NO: 2289 - RNA, 22 nt, Artificial Sequence
  Guide Sequence
aguccccgaauggguggaauac

SEQ ID NO: 2290 - RNA, 22 nt, Artificial Sequence
  Guide Sequence
auggguggaauaccgucaagcu

SEQ ID NO: 2291 - RNA, 22 nt, Artificial Sequence
  Guide Sequence
auuccacccauucggggacuuu

SEQ ID NO: 2292 - RNA, 22 nt, Artificial Sequence
  Guide Sequence
cagcuugacgguauuccaccca

SEQ ID NO: 2293 - RNA, 22 nt, Artificial Sequence
  Guide Sequence
ccagcuugacgguauuccaccc

SEQ ID NO: 2294 - RNA, 22 nt, Artificial Sequence
  Guide Sequence
ccccgaauggguggaauaccgu

SEQ ID NO: 2295 - RNA, 22 nt, Artificial Sequence
  Guide Sequence
cccgaauggguggaauaccguc

SEQ ID NO: 2296 - RNA, 22 nt, Artificial Sequence
  Guide Sequence
ccgaauggguggaauaccguca

SEQ ID NO: 2297 - RNA, 22 nt, Artificial Sequence
  Guide Sequence
cgaauggguggaauaccgucaa

SEQ ID NO: 2298 - RNA, 22 nt, Artificial Sequence
  Guide Sequence
cgguauuccacccauucgggga

SEQ ID NO: 2299 - RNA, 22 nt, Artificial Sequence
  Guide Sequence
cugaaaguccccgaaugggugg

SEQ ID NO: 2300 - RNA, 22 nt, Artificial Sequence
  Guide Sequence
cuugacgguauuccacccauuc

SEQ ID NO: 2301 - RNA, 22 nt, Artificial Sequence
  Guide Sequence
cuuggccagcuugacgguauuc

SEQ ID NO: 2302 - RNA, 22 nt, Artificial Sequence
  Guide Sequence
cuuugugcuuggccagcuugac

SEQ ID NO: 2303 - RNA, 22 nt, Artificial Sequence
  Guide Sequence
gaaaguccccgaauggguggaa

SEQ ID NO: 2304 - RNA, 22 nt, Artificial Sequence
  Guide Sequence
gaauaccgucaagcuggccaag

SEQ ID NO: 2305 - RNA, 22 nt, Artificial Sequence
  Guide Sequence
gaauggguggaauaccgucaag

SEQ ID NO: 2306 - RNA, 22 nt, Artificial Sequence
  Guide Sequence
gacgguauuccacccauucggg

SEQ ID NO: 2307 - RNA, 22 nt, Artificial Sequence
  Guide Sequence
gccagcuugacgguauuccacc

SEQ ID NO: 2308 - RNA, 22 nt, Artificial Sequence
  Guide Sequence
gcugaaaguccccgaaugggug

SEQ ID NO: 2309 - RNA, 22 nt, Artificial Sequence
  Guide Sequence
gcuugacgguauuccacccauu

SEQ ID NO: 2310 - RNA, 22 nt, Artificial Sequence
  Guide Sequence
gcuuggccagcuugacgguauu

SEQ ID NO: 2311 - RNA, 22 nt, Artificial Sequence
  Guide Sequence
ggaauaccgucaagcuggccaa

SEQ ID NO: 2312 - RNA, 22 nt, Artificial Sequence
  Guide Sequence
ggccagcuugacgguauuccac

SEQ ID NO: 2313 - RNA, 22 nt, Artificial Sequence
  Guide Sequence
ggguggaauaccgucaagcugg

SEQ ID NO: 2314 - RNA, 22 nt, Artificial Sequence
  Guide Sequence
gguauuccacccauucggggac

SEQ ID NO: 2315 - RNA, 22 nt, Artificial Sequence
  Guide Sequence
gguggaauaccgucaagcuggc

SEQ ID NO: 2316 - RNA, 22 nt, Artificial Sequence
  Guide Sequence
guauuccacccauucggggacu

SEQ ID NO: 2317 - RNA, 22 nt, Artificial Sequence
  Guide Sequence
guccccgaauggguggaauacc

SEQ ID NO: 2318 - RNA, 22 nt, Artificial Sequence
  Guide Sequence
gugcuuggccagcuugacggua

SEQ ID NO: 2319 - RNA, 22 nt, Artificial Sequence
  Guide Sequence
guggaauaccgucaagcuggcc

SEQ ID NO: 2320 - RNA, 22 nt, Artificial Sequence
  Guide Sequence
uaccgucaagcuggccaagcac

SEQ ID NO: 2321 - RNA, 22 nt, Artificial Sequence
  Guide Sequence
uauuccacccauucggggacuu

SEQ ID NO: 2322 - RNA, 22 nt, Artificial Sequence
  Guide Sequence
uccccgaauggguggaauaccg

SEQ ID NO: 2323 - RNA, 22 nt, Artificial Sequence
  Guide Sequence
ugaaaguccccgaaugggugga

SEQ ID NO: 2324 - RNA, 22 nt, Artificial Sequence
  Guide Sequence
ugacgguauuccacccauucgg

SEQ ID NO: 2325 - RNA, 22 nt, Artificial Sequence
  Guide Sequence
ugcuuggccagcuugacgguau

SEQ ID NO: 2326 - RNA, 22 nt, Artificial Sequence
  Guide Sequence
uggaauaccgucaagcuggcca

SEQ ID NO: 2327 - RNA, 22 nt, Artificial Sequence
  Guide Sequence
uggccagcuugacgguauucca

SEQ ID NO: 2328 - RNA, 22 nt, Artificial Sequence
  Guide Sequence
uggguggaauaccgucaagcug

SEQ ID NO: 2329 - RNA, 22 nt, Artificial Sequence
  Guide Sequence
ugugcuuggccagcuugacggu

SEQ ID NO: 2330 - RNA, 22 nt, Artificial Sequence
  Guide Sequence
uugacgguauuccacccauucg

SEQ ID NO: 2331 - RNA, 22 nt, Artificial Sequence
  Guide Sequence
uuggccagcuugacgguauucc

SEQ ID NO: 2332 - RNA, 22 nt, Artificial Sequence
  Guide Sequence
uugugcuuggccagcuugacgg

SEQ ID NO: 2333 - RNA, 22 nt, Artificial Sequence
  Guide Sequence
uuugugcuuggccagcuugacg

SEQ ID NO: 2334 - RNA, 20 nt, Artificial Sequence
  Guide Sequence
aagcacagagcuugcucccu

SEQ ID NO: 2335 - RNA, 20 nt, Artificial Sequence
  Guide Sequence
aagcucugugcuuggccagc

SEQ ID NO: 2336 - RNA, 20 nt, Artificial Sequence
  Guide Sequence
aagcuggccaagcacagagc

SEQ ID NO: 2337 - RNA, 20 nt, Artificial Sequence
  Guide Sequence
acagagcuugcucccuacga

SEQ ID NO: 2338 - RNA, 20 nt, Artificial Sequence
  Guide Sequence
accgucaagcuggccaagca

SEQ ID NO: 2339 - RNA, 20 nt, Artificial Sequence
  Guide Sequence
agcaagcucugugcuuggcc

SEQ ID NO: 2340 - RNA, 20 nt, Artificial Sequence
  Guide Sequence
agcacagagcuugcucccua

SEQ ID NO: 2341 - RNA, 20 nt, Artificial Sequence
  Guide Sequence
agcucugugcuuggccagcu

SEQ ID NO: 2342 - RNA, 20 nt, Artificial Sequence
  Guide Sequence
agcuggccaagcacagagcu

SEQ ID NO: 2343 - RNA, 20 nt, Artificial Sequence
  Guide Sequence
agggagcaagcucugugcuu

SEQ ID NO: 2344 - RNA, 20 nt, Artificial Sequence
  Guide Sequence
auaccgucaagcuggccaag

SEQ ID NO: 2345 - RNA, 20 nt, Artificial Sequence
  Guide Sequence
aucguagggagcaagcucug

SEQ ID NO: 2346 - RNA, 20 nt, Artificial Sequence
  Guide Sequence
caagcacagagcuugcuccc

SEQ ID NO: 2347 - RNA, 20 nt, Artificial Sequence
  Guide Sequence
caagcucugugcuuggccag

SEQ ID NO: 2348 - RNA, 20 nt, Artificial Sequence
  Guide Sequence
caagcuggccaagcacagag

SEQ ID NO: 2349 - RNA, 20 nt, Artificial Sequence
  Guide Sequence
cacagagcuugcucccuacg

SEQ ID NO: 2350 - RNA, 20 nt, Artificial Sequence
  Guide Sequence
caucguagggagcaagcucu

SEQ ID NO: 2351 - RNA, 20 nt, Artificial Sequence
  Guide Sequence
ccaagcacagagcuugcucc

SEQ ID NO: 2352 - RNA, 20 nt, Artificial Sequence
  Guide Sequence
ccgucaagcuggccaagcac

SEQ ID NO: 2353 - RNA, 20 nt, Artificial Sequence
  Guide Sequence
cguagggagcaagcucugug

SEQ ID NO: 2354 - RNA, 20 nt, Artificial Sequence
  Guide Sequence
cgucaagcuggccaagcaca

SEQ ID NO: 2355 - RNA, 20 nt, Artificial Sequence
  Guide Sequence
cucaucguagggagcaagcu

SEQ ID NO: 2356 - RNA, 20 nt, Artificial Sequence
  Guide Sequence
cucugugcuuggccagcuug

SEQ ID NO: 2357 - RNA, 20 nt, Artificial Sequence
  Guide Sequence
cuggccaagcacagagcuug

SEQ ID NO: 2358 - RNA, 20 nt, Artificial Sequence
  Guide Sequence
cugugcuuggccagcuugac

SEQ ID NO: 2359 - RNA, 20 nt, Artificial Sequence
  Guide Sequence
gagcaagcucugugcuuggc

SEQ ID NO: 2360 - RNA, 20 nt, Artificial Sequence
  Guide Sequence
gauaccgucaagcuggccaa

SEQ ID NO: 2361 - RNA, 20 nt, Artificial Sequence
  Guide Sequence
gcaagcucugugcuuggcca

SEQ ID NO: 2362 - RNA, 20 nt, Artificial Sequence
  Guide Sequence
gcacagagcuugcucccuac

SEQ ID NO: 2363 - RNA, 20 nt, Artificial Sequence
  Guide Sequence
gccaagcacagagcuugcuc

SEQ ID NO: 2364 - RNA, 20 nt, Artificial Sequence
  Guide Sequence
gcucugugcuuggccagcuu

SEQ ID NO: 2365 - RNA, 20 nt, Artificial Sequence
  Guide Sequence
gcuggccaagcacagagcuu

SEQ ID NO: 2366 - RNA, 20 nt, Artificial Sequence
  Guide Sequence
ggagcaagcucugugcuugg

SEQ ID NO: 2367 - RNA, 20 nt, Artificial Sequence
  Guide Sequence
ggccaagcacagagcuugcu

SEQ ID NO: 2368 - RNA, 20 nt, Artificial Sequence
  Guide Sequence
gggagcaagcucugugcuug

SEQ ID NO: 2369 - RNA, 20 nt, Artificial Sequence
  Guide Sequence
guagggagcaagcucugugc

SEQ ID NO: 2370 - RNA, 20 nt, Artificial Sequence
  Guide Sequence
gucaagcuggccaagcacag

SEQ ID NO: 2371 - RNA, 20 nt, Artificial Sequence
  Guide Sequence
uagggagcaagcucugugcu

SEQ ID NO: 2372 - RNA, 20 nt, Artificial Sequence
  Guide Sequence
ucaagcuggccaagcacaga

SEQ ID NO: 2373 - RNA, 20 nt, Artificial Sequence
  Guide Sequence
ucaucguagggagcaagcuc

SEQ ID NO: 2374 - RNA, 20 nt, Artificial Sequence
  Guide Sequence
ucguagggagcaagcucugu

SEQ ID NO: 2375 - RNA, 20 nt, Artificial Sequence
  Guide Sequence
ucucaucguagggagcaagc

SEQ ID NO: 2376 - RNA, 20 nt, Artificial Sequence
  Guide Sequence
ucugugcuuggccagcuuga

SEQ ID NO: 2377 - RNA, 20 nt, Artificial Sequence
  Guide Sequence
uggccaagcacagagcuugc

SEQ ID NO: 2378 - RNA, 21 nt, Artificial Sequence
  Guide Sequence
aagcacagagcuugcucccua

SEQ ID NO: 2379 - RNA, 21 nt, Artificial Sequence
  Guide Sequence
aagcucugugcuuggccagcu

SEQ ID NO: 2380 - RNA, 21 nt, Artificial Sequence
  Guide Sequence
aagcuggccaagcacagagcu

SEQ ID NO: 2381 - RNA, 21 nt, Artificial Sequence
  Guide Sequence
acagagcuugcucccuacgau

SEQ ID NO: 2382 - RNA, 21 nt, Artificial Sequence
  Guide Sequence
accgucaagcuggccaagcac

SEQ ID NO: 2383 - RNA, 21 nt, Artificial Sequence
  Guide Sequence
agcaagcucugugcuuggcca

SEQ ID NO: 2384 - RNA, 21 nt, Artificial Sequence
  Guide Sequence
agcacagagcuugcucccuac

SEQ ID NO: 2385 - RNA, 21 nt, Artificial Sequence
  Guide Sequence
agcucugugcuuggccagcuu

SEQ ID NO: 2386 - RNA, 21 nt, Artificial Sequence
  Guide Sequence
agcuggccaagcacagagcuu

SEQ ID NO: 2387 - RNA, 21 nt, Artificial Sequence
  Guide Sequence
agggagcaagcucugugcuug

SEQ ID NO: 2388 - RNA, 21 nt, Artificial Sequence
  Guide Sequence
auaccgucaagcuggccaagc

SEQ ID NO: 2389 - RNA, 21 nt, Artificial Sequence
  Guide Sequence
aucguagggagcaagcucugu

SEQ ID NO: 2390 - RNA, 21 nt, Artificial Sequence
  Guide Sequence
caagcacagagcuugcucccu

SEQ ID NO: 2391 - RNA, 21 nt, Artificial Sequence
  Guide Sequence
caagcucugugcuuggccagc

SEQ ID NO: 2392 - RNA, 21 nt, Artificial Sequence
  Guide Sequence
caagcuggccaagcacagagc

SEQ ID NO: 2393 - RNA, 21 nt, Artificial Sequence
  Guide Sequence
cacagagcuugcucccuacga

SEQ ID NO: 2394 - RNA, 21 nt, Artificial Sequence
  Guide Sequence
caucguagggagcaagcucug

SEQ ID NO: 2395 - RNA, 21 nt, Artificial Sequence
  Guide Sequence
ccaagcacagagcuugcuccc

SEQ ID NO: 2396 - RNA, 21 nt, Artificial Sequence
  Guide Sequence
ccgucaagcuggccaagcaca

SEQ ID NO: 2397 - RNA, 21 nt, Artificial Sequence
  Guide Sequence
cguagggagcaagcucugugc

SEQ ID NO: 2398 - RNA, 21 nt, Artificial Sequence
  Guide Sequence
cgucaagcuggccaagcacag

SEQ ID NO: 2399 - RNA, 21 nt, Artificial Sequence
  Guide Sequence
cucaucguagggagcaagcuc

SEQ ID NO: 2400 - RNA, 21 nt, Artificial Sequence
  Guide Sequence
cucugugcuuggccagcuuga

SEQ ID NO: 2401 - RNA, 21 nt, Artificial Sequence
  Guide Sequence
cuggccaagcacagagcuugc

SEQ ID NO: 2402 - RNA, 21 nt, Artificial Sequence
  Guide Sequence
cugugcuuggccagcuugacg

SEQ ID NO: 2403 - RNA, 21 nt, Artificial Sequence
  Guide Sequence
gagcaagcucugugcuuggcc

SEQ ID NO: 2404 - RNA, 21 nt, Artificial Sequence
  Guide Sequence
gauaccgucaagcuggccaag

SEQ ID NO: 2405 - RNA, 21 nt, Artificial Sequence
  Guide Sequence
gcaagcucugugcuuggccag

SEQ ID NO: 2406 - RNA, 21 nt, Artificial Sequence
  Guide Sequence
gcacagagcuugcucccuacg

SEQ ID NO: 2407 - RNA, 21 nt, Artificial Sequence
  Guide Sequence
gccaagcacagagcuugcucc

SEQ ID NO: 2408 - RNA, 21 nt, Artificial Sequence
  Guide Sequence
gcucugugcuuggccagcuug

SEQ ID NO: 2409 - RNA, 21 nt, Artificial Sequence
  Guide Sequence
gcuggccaagcacagagcuug

SEQ ID NO: 2410 - RNA, 21 nt, Artificial Sequence
  Guide Sequence
ggagcaagcucugugcuuggc

SEQ ID NO: 2411 - RNA, 21 nt, Artificial Sequence
  Guide Sequence
ggauaccgucaagcuggccaa

SEQ ID NO: 2412 - RNA, 21 nt, Artificial Sequence
  Guide Sequence
ggccaagcacagagcuugcuc

SEQ ID NO: 2413 - RNA, 21 nt, Artificial Sequence
  Guide Sequence
gggagcaagcucugugcuugg

SEQ ID NO: 2414 - RNA, 21 nt, Artificial Sequence
  Guide Sequence
guagggagcaagcucugugcu

SEQ ID NO: 2415 - RNA, 21 nt, Artificial Sequence
  Guide Sequence
gucaagcuggccaagcacaga

SEQ ID NO: 2416 - RNA, 21 nt, Artificial Sequence
  Guide Sequence
uagggagcaagcucugugcuu

SEQ ID NO: 2417 - RNA, 21 nt, Artificial Sequence
  Guide Sequence
ucaagcuggccaagcacagag

SEQ ID NO: 2418 - RNA, 21 nt, Artificial Sequence
  Guide Sequence
ucaucguagggagcaagcucu

SEQ ID NO: 2419 - RNA, 21 nt, Artificial Sequence
  Guide Sequence
ucguagggagcaagcucugug

SEQ ID NO: 2420 - RNA, 21 nt, Artificial Sequence
  Guide Sequence
ucucaucguagggagcaagcu

SEQ ID NO: 2421 - RNA, 21 nt, Artificial Sequence
  Guide Sequence
ucugugcuuggccagcuugac

SEQ ID NO: 2422 - RNA, 21 nt, Artificial Sequence
  Guide Sequence
uggccaagcacagagcuugcu

SEQ ID NO: 2423 - RNA, 21 nt, Artificial Sequence
  Guide Sequence
uucucaucguagggagcaagc

SEQ ID NO: 2424 - RNA, 22 nt, Artificial Sequence
  Guide Sequence
aagcacagagcuugcucccuac

SEQ ID NO: 2425 - RNA, 22 nt, Artificial Sequence
  Guide Sequence
aagcucugugcuuggccagcuu

SEQ ID NO: 2426 - RNA, 22 nt, Artificial Sequence
  Guide Sequence
aagcuggccaagcacagagcuu

SEQ ID NO: 2427 - RNA, 22 nt, Artificial Sequence
  Guide Sequence
acagagcuugcucccuacgaug

SEQ ID NO: 2428 - RNA, 22 nt, Artificial Sequence
  Guide Sequence
accgucaagcuggccaagcaca

SEQ ID NO: 2429 - RNA, 22 nt, Artificial Sequence
  Guide Sequence
agcaagcucugugcuuggccag

SEQ ID NO: 2430 - RNA, 22 nt, Artificial Sequence
  Guide Sequence
agcacagagcuugcucccuacg

SEQ ID NO: 2431 - RNA, 22 nt, Artificial Sequence
  Guide Sequence
agcucugugcuuggccagcuug

SEQ ID NO: 2432 - RNA, 22 nt, Artificial Sequence
  Guide Sequence
agcuggccaagcacagagcuug

SEQ ID NO: 2433 - RNA, 22 nt, Artificial Sequence
  Guide Sequence
agggagcaagcucugugcuugg

SEQ ID NO: 2434 - RNA, 22 nt, Artificial Sequence
  Guide Sequence
auaccgucaagcuggccaagca

SEQ ID NO: 2435 - RNA, 22 nt, Artificial Sequence
  Guide Sequence
aucguagggagcaagcucugug

SEQ ID NO: 2436 - RNA, 22 nt, Artificial Sequence
  Guide Sequence
caagcacagagcuugcucccua

SEQ ID NO: 2437 - RNA, 22 nt, Artificial Sequence
  Guide Sequence
caagcucugugcuuggccagcu

SEQ ID NO: 2438 - RNA, 22 nt, Artificial Sequence
  Guide Sequence
caagcuggccaagcacagagcu

SEQ ID NO: 2439 - RNA, 22 nt, Artificial Sequence
  Guide Sequence
cacagagcuugcucccuacgau

SEQ ID NO: 2440 - RNA, 22 nt, Artificial Sequence
  Guide Sequence
caucguagggagcaagcucugu

SEQ ID NO: 2441 - RNA, 22 nt, Artificial Sequence
  Guide Sequence
ccaagcacagagcuugcucccu

SEQ ID NO: 2442 - RNA, 22 nt, Artificial Sequence
  Guide Sequence
ccgucaagcuggccaagcacag

SEQ ID NO: 2443 - RNA, 22 nt, Artificial Sequence
  Guide Sequence
cguagggagcaagcucugugcu

SEQ ID NO: 2444 - RNA, 22 nt, Artificial Sequence
  Guide Sequence
cgucaagcuggccaagcacaga

SEQ ID NO: 2445 - RNA, 22 nt, Artificial Sequence
  Guide Sequence
cucaucguagggagcaagcucu

SEQ ID NO: 2446 - RNA, 22 nt, Artificial Sequence
  Guide Sequence
cucugugcuuggccagcuugac

SEQ ID NO: 2447 - RNA, 22 nt, Artificial Sequence
  Guide Sequence
cuggccaagcacagagcuugcu

SEQ ID NO: 2448 - RNA, 22 nt, Artificial Sequence
  Guide Sequence
cugugcuuggccagcuugacgg

SEQ ID NO: 2449 - RNA, 22 nt, Artificial Sequence
  Guide Sequence
gagcaagcucugugcuuggcca

SEQ ID NO: 2450 - RNA, 22 nt, Artificial Sequence
  Guide Sequence
gauaccgucaagcuggccaagc

SEQ ID NO: 2451 - RNA, 22 nt, Artificial Sequence
  Guide Sequence
gcaagcucugugcuuggccagc

SEQ ID NO: 2452 - RNA, 22 nt, Artificial Sequence
  Guide Sequence
gcacagagcuugcucccuacga

SEQ ID NO: 2453 - RNA, 22 nt, Artificial Sequence
  Guide Sequence
gccaagcacagagcuugcuccc

SEQ ID NO: 2454 - RNA, 22 nt, Artificial Sequence
  Guide Sequence
gcucugugcuuggccagcuuga

SEQ ID NO: 2455 - RNA, 22 nt, Artificial Sequence
  Guide Sequence
gcuggccaagcacagagcuugc

SEQ ID NO: 2456 - RNA, 22 nt, Artificial Sequence
  Guide Sequence
ggagcaagcucugugcuuggcc

SEQ ID NO: 2457 - RNA, 22 nt, Artificial Sequence
  Guide Sequence
ggauaccgucaagcuggccaag

SEQ ID NO: 2458 - RNA, 22 nt, Artificial Sequence
  Guide Sequence
ggccaagcacagagcuugcucc

SEQ ID NO: 2459 - RNA, 22 nt, Artificial Sequence
  Guide Sequence
gggagcaagcucugugcuuggc

SEQ ID NO: 2460 - RNA, 22 nt, Artificial Sequence
  Guide Sequence
guagggagcaagcucugugcuu

SEQ ID NO: 2461 - RNA, 22 nt, Artificial Sequence
  Guide Sequence
gucaagcuggccaagcacagag

SEQ ID NO: 2462 - RNA, 22 nt, Artificial Sequence
  Guide Sequence
guucucaucguagggagcaagc

SEQ ID NO: 2463 - RNA, 22 nt, Artificial Sequence
  Guide Sequence
uagggagcaagcucugugcuug

SEQ ID NO: 2464 - RNA, 22 nt, Artificial Sequence
  Guide Sequence
ucaagcuggccaagcacagagc

SEQ ID NO: 2465 - RNA, 22 nt, Artificial Sequence
  Guide Sequence
ucaucguagggagcaagcucug

SEQ ID NO: 2466 - RNA, 22 nt, Artificial Sequence
  Guide Sequence
ucguagggagcaagcucugugc

SEQ ID NO: 2467 - RNA, 22 nt, Artificial Sequence
  Guide Sequence
ucucaucguagggagcaagcuc

SEQ ID NO: 2468 - RNA, 22 nt, Artificial Sequence
  Guide Sequence
ucugugcuuggccagcuugacg

SEQ ID NO: 2469 - RNA, 22 nt, Artificial Sequence
  Guide Sequence
uggauaccgucaagcuggccaa

SEQ ID NO: 2470 - RNA, 22 nt, Artificial Sequence
  Guide Sequence
uggccaagcacagagcuugcuc

SEQ ID NO: 2471 - RNA, 22 nt, Artificial Sequence
  Guide Sequence
uucucaucguagggagcaagcu

SEQ ID NO: 2472 - RNA, 20 nt, Artificial Sequence
  Guide Sequence
aaagagcuugcuuccuacga

SEQ ID NO: 2473 - RNA, 20 nt, Artificial Sequence
  Guide Sequence
aaccaguucucaucguagga

SEQ ID NO: 2474 - RNA, 20 nt, Artificial Sequence
  Guide Sequence
aagagcuugcuuccuacgau

SEQ ID NO: 2475 - RNA, 20 nt, Artificial Sequence
  Guide Sequence
aagcacaaagagcuugcuuc

SEQ ID NO: 2476 - RNA, 20 nt, Artificial Sequence
  Guide Sequence
acaaagagcuugcuuccuac

SEQ ID NO: 2477 - RNA, 20 nt, Artificial Sequence
  Guide Sequence
accaguucucaucguaggaa

SEQ ID NO: 2478 - RNA, 20 nt, Artificial Sequence
  Guide Sequence
agaaccaguucucaucguag

SEQ ID NO: 2479 - RNA, 20 nt, Artificial Sequence
  Guide Sequence
agagcuugcuuccuacgaug

SEQ ID NO: 2480 - RNA, 20 nt, Artificial Sequence
  Guide Sequence
agcacaaagagcuugcuucc

SEQ ID NO: 2481 - RNA, 20 nt, Artificial Sequence
  Guide Sequence
agcuugcuuccuacgaugag

SEQ ID NO: 2482 - RNA, 20 nt, Artificial Sequence
  Guide Sequence
aggaagcaagcucuuugugc

SEQ ID NO: 2483 - RNA, 20 nt, Artificial Sequence
  Guide Sequence
aguucucaucguaggaagca

SEQ ID NO: 2484 - RNA, 20 nt, Artificial Sequence
  Guide Sequence
aucguaggaagcaagcucuu

SEQ ID NO: 2485 - RNA, 20 nt, Artificial Sequence
  Guide Sequence
caaagagcuugcuuccuacg

SEQ ID NO: 2486 - RNA, 20 nt, Artificial Sequence
  Guide Sequence
caagcacaaagagcuugcuu

SEQ ID NO: 2487 - RNA, 20 nt, Artificial Sequence
  Guide Sequence
cacaaagagcuugcuuccua

SEQ ID NO: 2488 - RNA, 20 nt, Artificial Sequence
  Guide Sequence
caguucucaucguaggaagc

SEQ ID NO: 2489 - RNA, 20 nt, Artificial Sequence
  Guide Sequence
caucguaggaagcaagcucu

SEQ ID NO: 2490 - RNA, 20 nt, Artificial Sequence
  Guide Sequence
ccaagcacaaagagcuugcu

SEQ ID NO: 2491 - RNA, 20 nt, Artificial Sequence
  Guide Sequence
ccaguucucaucguaggaag

SEQ ID NO: 2492 - RNA, 20 nt, Artificial Sequence
  Guide Sequence
cguaggaagcaagcucuuug

SEQ ID NO: 2493 - RNA, 20 nt, Artificial Sequence
  Guide Sequence
cucaucguaggaagcaagcu

SEQ ID NO: 2494 - RNA, 20 nt, Artificial Sequence
  Guide Sequence
cuuccuacgaugagaacugg

SEQ ID NO: 2495 - RNA, 20 nt, Artificial Sequence
  Guide Sequence
cuugcuuccuacgaugagaa

SEQ ID NO: 2496 - RNA, 20 nt, Artificial Sequence
  Guide Sequence
gaaccaguucucaucguagg

SEQ ID NO: 2497 - RNA, 20 nt, Artificial Sequence
  Guide Sequence
gaagcaagcucuuugugcuu

SEQ ID NO: 2498 - RNA, 20 nt, Artificial Sequence
  Guide Sequence
gagcuugcuuccuacgauga

SEQ ID NO: 2499 - RNA, 20 nt, Artificial Sequence
  Guide Sequence
gcacaaagagcuugcuuccu

SEQ ID NO: 2500 - RNA, 20 nt, Artificial Sequence
  Guide Sequence
gccaagcacaaagagcuugc

SEQ ID NO: 2501 - RNA, 20 nt, Artificial Sequence
  Guide Sequence
gcuuccuacgaugagaacug

SEQ ID NO: 2502 - RNA, 20 nt, Artificial Sequence
  Guide Sequence
gcuugcuuccuacgaugaga

SEQ ID NO: 2503 - RNA, 20 nt, Artificial Sequence
  Guide Sequence
ggaagcaagcucuuugugcu

SEQ ID NO: 2504 - RNA, 20 nt, Artificial Sequence
  Guide Sequence
ggccaagcacaaagagcuug

SEQ ID NO: 2505 - RNA, 20 nt, Artificial Sequence
  Guide Sequence
guagaaccaguucucaucgu

SEQ ID NO: 2506 - RNA, 20 nt, Artificial Sequence
  Guide Sequence
guaggaagcaagcucuuugu

SEQ ID NO: 2507 - RNA, 20 nt, Artificial Sequence
  Guide Sequence
guucucaucguaggaagcaa

SEQ ID NO: 2508 - RNA, 20 nt, Artificial Sequence
  Guide Sequence
uagaaccaguucucaucgua

SEQ ID NO: 2509 - RNA, 20 nt, Artificial Sequence
  Guide Sequence
uaggaagcaagcucuuugug

SEQ ID NO: 2510 - RNA, 20 nt, Artificial Sequence
  Guide Sequence
ucaucguaggaagcaagcuc

SEQ ID NO: 2511 - RNA, 20 nt, Artificial Sequence
  Guide Sequence
ucguaggaagcaagcucuuu

SEQ ID NO: 2512 - RNA, 20 nt, Artificial Sequence
  Guide Sequence
ucucaucguaggaagcaagc

SEQ ID NO: 2513 - RNA, 20 nt, Artificial Sequence
  Guide Sequence
ugcuuccuacgaugagaacu

SEQ ID NO: 2514 - RNA, 20 nt, Artificial Sequence
  Guide Sequence
uggccaagcacaaagagcuu

SEQ ID NO: 2515 - RNA, 20 nt, Artificial Sequence
  Guide Sequence
uuccuacgaugagaacuggu

SEQ ID NO: 2516 - RNA, 20 nt, Artificial Sequence
  Guide Sequence
uucucaucguaggaagcaag

SEQ ID NO: 2517 - RNA, 20 nt, Artificial Sequence
  Guide Sequence
uugcuuccuacgaugagaac

SEQ ID NO: 2518 - RNA, 21 nt, Artificial Sequence
  Guide Sequence
aaagagcuugcuuccuacgau

SEQ ID NO: 2519 - RNA, 21 nt, Artificial Sequence
  Guide Sequence
aaccaguucucaucguaggaa

SEQ ID NO: 2520 - RNA, 21 nt, Artificial Sequence
  Guide Sequence
aagagcuugcuuccuacgaug

SEQ ID NO: 2521 - RNA, 21 nt, Artificial Sequence
  Guide Sequence
aagcacaaagagcuugcuucc

SEQ ID NO: 2522 - RNA, 21 nt, Artificial Sequence
  Guide Sequence
acaaagagcuugcuuccuacg

SEQ ID NO: 2523 - RNA, 21 nt, Artificial Sequence
  Guide Sequence
accaguucucaucguaggaag

SEQ ID NO: 2524 - RNA, 21 nt, Artificial Sequence
  Guide Sequence
agaaccaguucucaucguagg

SEQ ID NO: 2525 - RNA, 21 nt, Artificial Sequence
  Guide Sequence
agagcuugcuuccuacgauga

SEQ ID NO: 2526 - RNA, 21 nt, Artificial Sequence
  Guide Sequence
agcacaaagagcuugcuuccu

SEQ ID NO: 2527 - RNA, 21 nt, Artificial Sequence
  Guide Sequence
agcuugcuuccuacgaugaga

SEQ ID NO: 2528 - RNA, 21 nt, Artificial Sequence
  Guide Sequence
aggaagcaagcucuuugugcu

SEQ ID NO: 2529 - RNA, 21 nt, Artificial Sequence
  Guide Sequence
aguucucaucguaggaagcaa

SEQ ID NO: 2530 - RNA, 21 nt, Artificial Sequence
  Guide Sequence
aucguaggaagcaagcucuuu

SEQ ID NO: 2531 - RNA, 21 nt, Artificial Sequence
  Guide Sequence
caaagagcuugcuuccuacga

SEQ ID NO: 2532 - RNA, 21 nt, Artificial Sequence
  Guide Sequence
caagcacaaagagcuugcuuc

SEQ ID NO: 2533 - RNA, 21 nt, Artificial Sequence
  Guide Sequence
cacaaagagcuugcuuccuac

SEQ ID NO: 2534 - RNA, 21 nt, Artificial Sequence
  Guide Sequence
caguucucaucguaggaagca

SEQ ID NO: 2535 - RNA, 21 nt, Artificial Sequence
  Guide Sequence
caucguaggaagcaagcucuu

SEQ ID NO: 2536 - RNA, 21 nt, Artificial Sequence
  Guide Sequence
ccaagcacaaagagcuugcuu

SEQ ID NO: 2537 - RNA, 21 nt, Artificial Sequence
  Guide Sequence
ccaguucucaucguaggaagc

SEQ ID NO: 2538 - RNA, 21 nt, Artificial Sequence
  Guide Sequence
cguaggaagcaagcucuuugu

SEQ ID NO: 2539 - RNA, 21 nt, Artificial Sequence
  Guide Sequence
cucaucguaggaagcaagcuc

SEQ ID NO: 2540 - RNA, 21 nt, Artificial Sequence
  Guide Sequence
cuggccaagcacaaagagcuu

SEQ ID NO: 2541 - RNA, 21 nt, Artificial Sequence
  Guide Sequence
cuuccuacgaugagaacuggu

SEQ ID NO: 2542 - RNA, 21 nt, Artificial Sequence
  Guide Sequence
cuugcuuccuacgaugagaac

SEQ ID NO: 2543 - RNA, 21 nt, Artificial Sequence
  Guide Sequence
gaaccaguucucaucguagga

SEQ ID NO: 2544 - RNA, 21 nt, Artificial Sequence
  Guide Sequence
gaagcaagcucuuugugcuug

SEQ ID NO: 2545 - RNA, 21 nt, Artificial Sequence
  Guide Sequence
gagcuugcuuccuacgaugag

SEQ ID NO: 2546 - RNA, 21 nt, Artificial Sequence
  Guide Sequence
gcacaaagagcuugcuuccua

SEQ ID NO: 2547 - RNA, 21 nt, Artificial Sequence
  Guide Sequence
gccaagcacaaagagcuugcu

SEQ ID NO: 2548 - RNA, 21 nt, Artificial Sequence
  Guide Sequence
gcuuccuacgaugagaacugg

SEQ ID NO: 2549 - RNA, 21 nt, Artificial Sequence
  Guide Sequence
gcuugcuuccuacgaugagaa

SEQ ID NO: 2550 - RNA, 21 nt, Artificial Sequence
  Guide Sequence
ggaagcaagcucuuugugcuu

SEQ ID NO: 2551 - RNA, 21 nt, Artificial Sequence
  Guide Sequence
ggccaagcacaaagagcuugc

SEQ ID NO: 2552 - RNA, 21 nt, Artificial Sequence
  Guide Sequence
guagaaccaguucucaucgua

SEQ ID NO: 2553 - RNA, 21 nt, Artificial Sequence
  Guide Sequence
guaggaagcaagcucuuugug

SEQ ID NO: 2554 - RNA, 21 nt, Artificial Sequence
  Guide Sequence
guucucaucguaggaagcaag

SEQ ID NO: 2555 - RNA, 21 nt, Artificial Sequence
  Guide Sequence
uagaaccaguucucaucguag

SEQ ID NO: 2556 - RNA, 21 nt, Artificial Sequence
  Guide Sequence
uaggaagcaagcucuuugugc

SEQ ID NO: 2557 - RNA, 21 nt, Artificial Sequence
  Guide Sequence
ucaucguaggaagcaagcucu

SEQ ID NO: 2558 - RNA, 21 nt, Artificial Sequence
  Guide Sequence
ucguaggaagcaagcucuuug

SEQ ID NO: 2559 - RNA, 21 nt, Artificial Sequence
  Guide Sequence
ucucaucguaggaagcaagcu

SEQ ID NO: 2560 - RNA, 21 nt, Artificial Sequence
  Guide Sequence
ugcuuccuacgaugagaacug

SEQ ID NO: 2561 - RNA, 21 nt, Artificial Sequence
  Guide Sequence
uggccaagcacaaagagcuug

SEQ ID NO: 2562 - RNA, 21 nt, Artificial Sequence
  Guide Sequence
uguagaaccaguucucaucgu

SEQ ID NO: 2563 - RNA, 21 nt, Artificial Sequence
  Guide Sequence
uuccuacgaugagaacugguu

SEQ ID NO: 2564 - RNA, 21 nt, Artificial Sequence
  Guide Sequence
uucucaucguaggaagcaagc

SEQ ID NO: 2565 - RNA, 21 nt, Artificial Sequence
  Guide Sequence
uugcuuccuacgaugagaacu

SEQ ID NO: 2566 - RNA, 22 nt, Artificial Sequence
  Guide Sequence
aaagagcuugcuuccuacgaug

SEQ ID NO: 2567 - RNA, 22 nt, Artificial Sequence
  Guide Sequence
aaccaguucucaucguaggaag

SEQ ID NO: 2568 - RNA, 22 nt, Artificial Sequence
  Guide Sequence
aagagcuugcuuccuacgauga

SEQ ID NO: 2569 - RNA, 22 nt, Artificial Sequence
  Guide Sequence
aagcacaaagagcuugcuuccu

SEQ ID NO: 2570 - RNA, 22 nt, Artificial Sequence
  Guide Sequence
acaaagagcuugcuuccuacga

SEQ ID NO: 2571 - RNA, 22 nt, Artificial Sequence
  Guide Sequence
accaguucucaucguaggaagc

SEQ ID NO: 2572 - RNA, 22 nt, Artificial Sequence
  Guide Sequence
agaaccaguucucaucguagga

SEQ ID NO: 2573 - RNA, 22 nt, Artificial Sequence
  Guide Sequence
agagcuugcuuccuacgaugag

SEQ ID NO: 2574 - RNA, 22 nt, Artificial Sequence
  Guide Sequence
agcacaaagagcuugcuuccua

SEQ ID NO: 2575 - RNA, 22 nt, Artificial Sequence
  Guide Sequence
agcuugcuuccuacgaugagaa

SEQ ID NO: 2576 - RNA, 22 nt, Artificial Sequence
  Guide Sequence
aggaagcaagcucuuugugcuu

SEQ ID NO: 2577 - RNA, 22 nt, Artificial Sequence
  Guide Sequence
aguucucaucguaggaagcaag

SEQ ID NO: 2578 - RNA, 22 nt, Artificial Sequence
  Guide Sequence
aucguaggaagcaagcucuuug

SEQ ID NO: 2579 - RNA, 22 nt, Artificial Sequence
  Guide Sequence
caaagagcuugcuuccuacgau

SEQ ID NO: 2580 - RNA, 22 nt, Artificial Sequence
  Guide Sequence
caagcacaaagagcuugcuucc

SEQ ID NO: 2581 - RNA, 22 nt, Artificial Sequence
  Guide Sequence
cacaaagagcuugcuuccuacg

SEQ ID NO: 2582 - RNA, 22 nt, Artificial Sequence
  Guide Sequence
caguucucaucguaggaagcaa

SEQ ID NO: 2583 - RNA, 22 nt, Artificial Sequence
  Guide Sequence
caucguaggaagcaagcucuuu

SEQ ID NO: 2584 - RNA, 22 nt, Artificial Sequence
  Guide Sequence
ccaagcacaaagagcuugcuuc

SEQ ID NO: 2585 - RNA, 22 nt, Artificial Sequence
  Guide Sequence
ccaguucucaucguaggaagca

SEQ ID NO: 2586 - RNA, 22 nt, Artificial Sequence
  Guide Sequence
cguaggaagcaagcucuuugug

SEQ ID NO: 2587 - RNA, 22 nt, Artificial Sequence
  Guide Sequence
cucaucguaggaagcaagcucu

SEQ ID NO: 2588 - RNA, 22 nt, Artificial Sequence
  Guide Sequence
cuggccaagcacaaagagcuug

SEQ ID NO: 2589 - RNA, 22 nt, Artificial Sequence
  Guide Sequence
cuuccuacgaugagaacugguu

SEQ ID NO: 2590 - RNA, 22 nt, Artificial Sequence
  Guide Sequence
cuugcuuccuacgaugagaacu

SEQ ID NO: 2591 - RNA, 22 nt, Artificial Sequence
  Guide Sequence
gaaccaguucucaucguaggaa

SEQ ID NO: 2592 - RNA, 22 nt, Artificial Sequence
  Guide Sequence
gaagcaagcucuuugugcuugg

SEQ ID NO: 2593 - RNA, 22 nt, Artificial Sequence
  Guide Sequence
gagcuugcuuccuacgaugaga

SEQ ID NO: 2594 - RNA, 22 nt, Artificial Sequence
  Guide Sequence
gcacaaagagcuugcuuccuac

SEQ ID NO: 2595 - RNA, 22 nt, Artificial Sequence
  Guide Sequence
gccaagcacaaagagcuugcuu

SEQ ID NO: 2596 - RNA, 22 nt, Artificial Sequence
  Guide Sequence
gcuggccaagcacaaagagcuu

SEQ ID NO: 2597 - RNA, 22 nt, Artificial Sequence
  Guide Sequence
gcuuccuacgaugagaacuggu

SEQ ID NO: 2598 - RNA, 22 nt, Artificial Sequence
  Guide Sequence
gcuugcuuccuacgaugagaac

SEQ ID NO: 2599 - RNA, 22 nt, Artificial Sequence
  Guide Sequence
ggaagcaagcucuuugugcuug

SEQ ID NO: 2600 - RNA, 22 nt, Artificial Sequence
  Guide Sequence
ggccaagcacaaagagcuugcu

SEQ ID NO: 2601 - RNA, 22 nt, Artificial Sequence
  Guide Sequence
guagaaccaguucucaucguag

SEQ ID NO: 2602 - RNA, 22 nt, Artificial Sequence
  Guide Sequence
guaggaagcaagcucuuugugc

SEQ ID NO: 2603 - RNA, 22 nt, Artificial Sequence
  Guide Sequence
guguagaaccaguucucaucgu

SEQ ID NO: 2604 - RNA, 22 nt, Artificial Sequence
  Guide Sequence
guucucaucguaggaagcaagc

SEQ ID NO: 2605 - RNA, 22 nt, Artificial Sequence
  Guide Sequence
uagaaccaguucucaucguagg

SEQ ID NO: 2606 - RNA, 22 nt, Artificial Sequence
  Guide Sequence
uaggaagcaagcucuuugugcu

SEQ ID NO: 2607 - RNA, 22 nt, Artificial Sequence
  Guide Sequence
ucaucguaggaagcaagcucuu

SEQ ID NO: 2608 - RNA, 22 nt, Artificial Sequence
  Guide Sequence
ucguaggaagcaagcucuuugu

SEQ ID NO: 2609 - RNA, 22 nt, Artificial Sequence
  Guide Sequence
ucucaucguaggaagcaagcuc

SEQ ID NO: 2610 - RNA, 22 nt, Artificial Sequence
  Guide Sequence
ugcuuccuacgaugagaacugg

SEQ ID NO: 2611 - RNA, 22 nt, Artificial Sequence
  Guide Sequence
uggccaagcacaaagagcuugc

SEQ ID NO: 2612 - RNA, 22 nt, Artificial Sequence
  Guide Sequence
uguagaaccaguucucaucgua

SEQ ID NO: 2613 - RNA, 22 nt, Artificial Sequence
  Guide Sequence
uuccuacgaugagaacugguuc

SEQ ID NO: 2614 - RNA, 22 nt, Artificial Sequence
  Guide Sequence
uucucaucguaggaagcaagcu

SEQ ID NO: 2615 - RNA, 22 nt, Artificial Sequence
  Guide Sequence
uugcuuccuacgaugagaacug

SEQ ID NO: 2616 - RNA, 20 nt, Artificial Sequence
  Guide Sequence
aacugguucuacaugcgagc

SEQ ID NO: 2617 - RNA, 20 nt, Artificial Sequence
  Guide Sequence
aaguuccucaccagcucgca

SEQ ID NO: 2618 - RNA, 20 nt, Artificial Sequence
  Guide Sequence
acaugcgagcuggugaggaa

SEQ ID NO: 2619 - RNA, 20 nt, Artificial Sequence
  Guide Sequence
accagcucgcauguagaacc

SEQ ID NO: 2620 - RNA, 20 nt, Artificial Sequence
  Guide Sequence
accuaaguuccucaccagcu

SEQ ID NO: 2621 - RNA, 20 nt, Artificial Sequence
  Guide Sequence
acgaugagaacugguucuac

SEQ ID NO: 2622 - RNA, 20 nt, Artificial Sequence
  Guide Sequence
acugguucuacaugcgagcu

SEQ ID NO: 2623 - RNA, 20 nt, Artificial Sequence
  Guide Sequence
agaacugguucuacaugcga

SEQ ID NO: 2624 - RNA, 20 nt, Artificial Sequence
  Guide Sequence
agcucgcauguagaaccagu

SEQ ID NO: 2625 - RNA, 20 nt, Artificial Sequence
  Guide Sequence
aguuccucaccagcucgcau

SEQ ID NO: 2626 - RNA, 20 nt, Artificial Sequence
  Guide Sequence
augagaacugguucuacaug

SEQ ID NO: 2627 - RNA, 20 nt, Artificial Sequence
  Guide Sequence
augcgagcuggugaggaacu

SEQ ID NO: 2628 - RNA, 20 nt, Artificial Sequence
  Guide Sequence
caccagcucgcauguagaac

SEQ ID NO: 2629 - RNA, 20 nt, Artificial Sequence
  Guide Sequence
cagcucgcauguagaaccag

SEQ ID NO: 2630 - RNA, 20 nt, Artificial Sequence
  Guide Sequence
caugcgagcuggugaggaac

SEQ ID NO: 2631 - RNA, 20 nt, Artificial Sequence
  Guide Sequence
cauguagaaccaguucucau

SEQ ID NO: 2632 - RNA, 20 nt, Artificial Sequence
  Guide Sequence
ccagcucgcauguagaacca

SEQ ID NO: 2633 - RNA, 20 nt, Artificial Sequence
  Guide Sequence
ccuaaguuccucaccagcuc

SEQ ID NO: 2634 - RNA, 20 nt, Artificial Sequence
  Guide Sequence
ccucaccagcucgcauguag

SEQ ID NO: 2635 - RNA, 20 nt, Artificial Sequence
  Guide Sequence
cgaugagaacugguucuaca

SEQ ID NO: 2636 - RNA, 20 nt, Artificial Sequence
  Guide Sequence
cgcauguagaaccaguucuc

SEQ ID NO: 2637 - RNA, 20 nt, Artificial Sequence
  Guide Sequence
cuaaguuccucaccagcucg

SEQ ID NO: 2638 - RNA, 20 nt, Artificial Sequence
  Guide Sequence
cuacaugcgagcuggugagg

SEQ ID NO: 2639 - RNA, 20 nt, Artificial Sequence
  Guide Sequence
cuacgaugagaacugguucu

SEQ ID NO: 2640 - RNA, 20 nt, Artificial Sequence
  Guide Sequence
cucaccagcucgcauguaga

SEQ ID NO: 2641 - RNA, 20 nt, Artificial Sequence
  Guide Sequence
cucgcauguagaaccaguuc

SEQ ID NO: 2642 - RNA, 20 nt, Artificial Sequence
  Guide Sequence
cugguucuacaugcgagcug

SEQ ID NO: 2643 - RNA, 20 nt, Artificial Sequence
  Guide Sequence
gaacugguucuacaugcgag

SEQ ID NO: 2644 - RNA, 20 nt, Artificial Sequence
  Guide Sequence
gagaacugguucuacaugcg

SEQ ID NO: 2645 - RNA, 20 nt, Artificial Sequence
  Guide Sequence
gaugagaacugguucuacau

SEQ ID NO: 2646 - RNA, 20 nt, Artificial Sequence
  Guide Sequence
gcauguagaaccaguucuca

SEQ ID NO: 2647 - RNA, 20 nt, Artificial Sequence
  Guide Sequence
gcucgcauguagaaccaguu

SEQ ID NO: 2648 - RNA, 20 nt, Artificial Sequence
  Guide Sequence
gguucuacaugcgagcuggu

SEQ ID NO: 2649 - RNA, 20 nt, Artificial Sequence
  Guide Sequence
guuccucaccagcucgcaug

SEQ ID NO: 2650 - RNA, 20 nt, Artificial Sequence
  Guide Sequence
guucuacaugcgagcuggug

SEQ ID NO: 2651 - RNA, 20 nt, Artificial Sequence
  Guide Sequence
uaaguuccucaccagcucgc

SEQ ID NO: 2652 - RNA, 20 nt, Artificial Sequence
  Guide Sequence
uacaugcgagcuggugagga

SEQ ID NO: 2653 - RNA, 20 nt, Artificial Sequence
  Guide Sequence
uacgaugagaacugguucua

SEQ ID NO: 2654 - RNA, 20 nt, Artificial Sequence
  Guide Sequence
ucaccagcucgcauguagaa

SEQ ID NO: 2655 - RNA, 20 nt, Artificial Sequence
  Guide Sequence
uccucaccagcucgcaugua

SEQ ID NO: 2656 - RNA, 20 nt, Artificial Sequence
  Guide Sequence
ucgcauguagaaccaguucu

SEQ ID NO: 2657 - RNA, 20 nt, Artificial Sequence
  Guide Sequence
ucuacaugcgagcuggugag

SEQ ID NO: 2658 - RNA, 20 nt, Artificial Sequence
  Guide Sequence
ugagaacugguucuacaugc

SEQ ID NO: 2659 - RNA, 20 nt, Artificial Sequence
  Guide Sequence
ugguucuacaugcgagcugg

SEQ ID NO: 2660 - RNA, 20 nt, Artificial Sequence
  Guide Sequence
uuccucaccagcucgcaugu

SEQ ID NO: 2661 - RNA, 20 nt, Artificial Sequence
  Guide Sequence
uucuacaugcgagcugguga

SEQ ID NO: 2662 - RNA, 21 nt, Artificial Sequence
  Guide Sequence
aacugguucuacaugcgagcu

SEQ ID NO: 2663 - RNA, 21 nt, Artificial Sequence
  Guide Sequence
aaguuccucaccagcucgcau

SEQ ID NO: 2664 - RNA, 21 nt, Artificial Sequence
  Guide Sequence
acaugcgagcuggugaggaac

SEQ ID NO: 2665 - RNA, 21 nt, Artificial Sequence
  Guide Sequence
accagcucgcauguagaacca

SEQ ID NO: 2666 - RNA, 21 nt, Artificial Sequence
  Guide Sequence
accuaaguuccucaccagcuc

SEQ ID NO: 2667 - RNA, 21 nt, Artificial Sequence
  Guide Sequence
acgaugagaacugguucuaca

SEQ ID NO: 2668 - RNA, 21 nt, Artificial Sequence
  Guide Sequence
acugguucuacaugcgagcug

SEQ ID NO: 2669 - RNA, 21 nt, Artificial Sequence
  Guide Sequence
agaacugguucuacaugcgag

SEQ ID NO: 2670 - RNA, 21 nt, Artificial Sequence
  Guide Sequence
agcucgcauguagaaccaguu

SEQ ID NO: 2671 - RNA, 21 nt, Artificial Sequence
  Guide Sequence
aguuccucaccagcucgcaug

SEQ ID NO: 2672 - RNA, 21 nt, Artificial Sequence
  Guide Sequence
augagaacugguucuacaugc

SEQ ID NO: 2673 - RNA, 21 nt, Artificial Sequence
  Guide Sequence
augcgagcuggugaggaacuu

SEQ ID NO: 2674 - RNA, 21 nt, Artificial Sequence
  Guide Sequence
caccagcucgcauguagaacc

SEQ ID NO: 2675 - RNA, 21 nt, Artificial Sequence
  Guide Sequence
cagcucgcauguagaaccagu

SEQ ID NO: 2676 - RNA, 21 nt, Artificial Sequence
  Guide Sequence
caugcgagcuggugaggaacu

SEQ ID NO: 2677 - RNA, 21 nt, Artificial Sequence
  Guide Sequence
cauguagaaccaguucucauc

SEQ ID NO: 2678 - RNA, 21 nt, Artificial Sequence
  Guide Sequence
ccagcucgcauguagaaccag

SEQ ID NO: 2679 - RNA, 21 nt, Artificial Sequence
  Guide Sequence
ccuaaguuccucaccagcucg

SEQ ID NO: 2680 - RNA, 21 nt, Artificial Sequence
  Guide Sequence
ccuacgaugagaacugguucu

SEQ ID NO: 2681 - RNA, 21 nt, Artificial Sequence
  Guide Sequence
ccucaccagcucgcauguaga

SEQ ID NO: 2682 - RNA, 21 nt, Artificial Sequence
  Guide Sequence
cgaugagaacugguucuacau

SEQ ID NO: 2683 - RNA, 21 nt, Artificial Sequence
  Guide Sequence
cgcauguagaaccaguucuca

SEQ ID NO: 2684 - RNA, 21 nt, Artificial Sequence
  Guide Sequence
cuaaguuccucaccagcucgc

SEQ ID NO: 2685 - RNA, 21 nt, Artificial Sequence
  Guide Sequence
cuacaugcgagcuggugagga

SEQ ID NO: 2686 - RNA, 21 nt, Artificial Sequence
  Guide Sequence
cuacgaugagaacugguucua

SEQ ID NO: 2687 - RNA, 21 nt, Artificial Sequence
  Guide Sequence
cucaccagcucgcauguagaa

SEQ ID NO: 2688 - RNA, 21 nt, Artificial Sequence
  Guide Sequence
cucgcauguagaaccaguucu

SEQ ID NO: 2689 - RNA, 21 nt, Artificial Sequence
  Guide Sequence
cugguucuacaugcgagcugg

SEQ ID NO: 2690 - RNA, 21 nt, Artificial Sequence
  Guide Sequence
gaacugguucuacaugcgagc

SEQ ID NO: 2691 - RNA, 21 nt, Artificial Sequence
  Guide Sequence
gaccuaaguuccucaccagcu

SEQ ID NO: 2692 - RNA, 21 nt, Artificial Sequence
  Guide Sequence
gagaacugguucuacaugcga

SEQ ID NO: 2693 - RNA, 21 nt, Artificial Sequence
  Guide Sequence
gaugagaacugguucuacaug

SEQ ID NO: 2694 - RNA, 21 nt, Artificial Sequence
  Guide Sequence
gcauguagaaccaguucucau

SEQ ID NO: 2695 - RNA, 21 nt, Artificial Sequence
  Guide Sequence
gcucgcauguagaaccaguuc

SEQ ID NO: 2696 - RNA, 21 nt, Artificial Sequence
  Guide Sequence
gguucuacaugcgagcuggug

SEQ ID NO: 2697 - RNA, 21 nt, Artificial Sequence
  Guide Sequence
guuccucaccagcucgcaugu

SEQ ID NO: 2698 - RNA, 21 nt, Artificial Sequence
  Guide Sequence
guucuacaugcgagcugguga

SEQ ID NO: 2699 - RNA, 21 nt, Artificial Sequence
  Guide Sequence
uaaguuccucaccagcucgca

SEQ ID NO: 2700 - RNA, 21 nt, Artificial Sequence
  Guide Sequence
uacaugcgagcuggugaggaa

SEQ ID NO: 2701 - RNA, 21 nt, Artificial Sequence
  Guide Sequence
uacgaugagaacugguucuac

SEQ ID NO: 2702 - RNA, 21 nt, Artificial Sequence
  Guide Sequence
ucaccagcucgcauguagaac

SEQ ID NO: 2703 - RNA, 21 nt, Artificial Sequence
  Guide Sequence
uccucaccagcucgcauguag

SEQ ID NO: 2704 - RNA, 21 nt, Artificial Sequence
  Guide Sequence
ucgcauguagaaccaguucuc

SEQ ID NO: 2705 - RNA, 21 nt, Artificial Sequence
  Guide Sequence
ucuacaugcgagcuggugagg

SEQ ID NO: 2706 - RNA, 21 nt, Artificial Sequence
  Guide Sequence
ugagaacugguucuacaugcg

SEQ ID NO: 2707 - RNA, 21 nt, Artificial Sequence
  Guide Sequence
ugguucuacaugcgagcuggu

SEQ ID NO: 2708 - RNA, 21 nt, Artificial Sequence
  Guide Sequence
uuccucaccagcucgcaugua

SEQ ID NO: 2709 - RNA, 21 nt, Artificial Sequence
  Guide Sequence
uucuacaugcgagcuggugag

SEQ ID NO: 2710 - RNA, 22 nt, Artificial Sequence
  Guide Sequence
aacugguucuacaugcgagcug

SEQ ID NO: 2711 - RNA, 22 nt, Artificial Sequence
  Guide Sequence
aaguuccucaccagcucgcaug

SEQ ID NO: 2712 - RNA, 22 nt, Artificial Sequence
  Guide Sequence
acaugcgagcuggugaggaacu

SEQ ID NO: 2713 - RNA, 22 nt, Artificial Sequence
  Guide Sequence
accagcucgcauguagaaccag

SEQ ID NO: 2714 - RNA, 22 nt, Artificial Sequence
  Guide Sequence
accuaaguuccucaccagcucg

SEQ ID NO: 2715 - RNA, 22 nt, Artificial Sequence
  Guide Sequence
acgaugagaacugguucuacau

SEQ ID NO: 2716 - RNA, 22 nt, Artificial Sequence
  Guide Sequence
acugguucuacaugcgagcugg

SEQ ID NO: 2717 - RNA, 22 nt, Artificial Sequence
  Guide Sequence
agaacugguucuacaugcgagc

SEQ ID NO: 2718 - RNA, 22 nt, Artificial Sequence
  Guide Sequence
agaccuaaguuccucaccagcu

SEQ ID NO: 2719 - RNA, 22 nt, Artificial Sequence
  Guide Sequence
agcucgcauguagaaccaguuc

SEQ ID NO: 2720 - RNA, 22 nt, Artificial Sequence
  Guide Sequence
aguuccucaccagcucgcaugu

SEQ ID NO: 2721 - RNA, 22 nt, Artificial Sequence
  Guide Sequence
augagaacugguucuacaugcg

SEQ ID NO: 2722 - RNA, 22 nt, Artificial Sequence
  Guide Sequence
augcgagcuggugaggaacuua

SEQ ID NO: 2723 - RNA, 22 nt, Artificial Sequence
  Guide Sequence
caccagcucgcauguagaacca

SEQ ID NO: 2724 - RNA, 22 nt, Artificial Sequence
  Guide Sequence
cagcucgcauguagaaccaguu

SEQ ID NO: 2725 - RNA, 22 nt, Artificial Sequence
  Guide Sequence
caugcgagcuggugaggaacuu

SEQ ID NO: 2726 - RNA, 22 nt, Artificial Sequence
  Guide Sequence
cauguagaaccaguucucaucg

SEQ ID NO: 2727 - RNA, 22 nt, Artificial Sequence
  Guide Sequence
ccagcucgcauguagaaccagu

SEQ ID NO: 2728 - RNA, 22 nt, Artificial Sequence
  Guide Sequence
cccuacgaugagaacugguucu

SEQ ID NO: 2729 - RNA, 22 nt, Artificial Sequence
  Guide Sequence
ccuaaguuccucaccagcucgc

SEQ ID NO: 2730 - RNA, 22 nt, Artificial Sequence
  Guide Sequence
ccuacgaugagaacugguucua

SEQ ID NO: 2731 - RNA, 22 nt, Artificial Sequence
  Guide Sequence
ccucaccagcucgcauguagaa

SEQ ID NO: 2732 - RNA, 22 nt, Artificial Sequence
  Guide Sequence
cgaugagaacugguucuacaug

SEQ ID NO: 2733 - RNA, 22 nt, Artificial Sequence
  Guide Sequence
cgcauguagaaccaguucucau

SEQ ID NO: 2734 - RNA, 22 nt, Artificial Sequence
  Guide Sequence
cuaaguuccucaccagcucgca

SEQ ID NO: 2735 - RNA, 22 nt, Artificial Sequence
  Guide Sequence
cuacaugcgagcuggugaggaa

SEQ ID NO: 2736 - RNA, 22 nt, Artificial Sequence
  Guide Sequence
cuacgaugagaacugguucuac

SEQ ID NO: 2737 - RNA, 22 nt, Artificial Sequence
  Guide Sequence
cucaccagcucgcauguagaac

SEQ ID NO: 2738 - RNA, 22 nt, Artificial Sequence
  Guide Sequence
cucgcauguagaaccaguucuc

SEQ ID NO: 2739 - RNA, 22 nt, Artificial Sequence
  Guide Sequence
cugguucuacaugcgagcuggu

SEQ ID NO: 2740 - RNA, 22 nt, Artificial Sequence
  Guide Sequence
gaacugguucuacaugcgagcu

SEQ ID NO: 2741 - RNA, 22 nt, Artificial Sequence
  Guide Sequence
gaccuaaguuccucaccagcuc

SEQ ID NO: 2742 - RNA, 22 nt, Artificial Sequence
  Guide Sequence
gagaacugguucuacaugcgag

SEQ ID NO: 2743 - RNA, 22 nt, Artificial Sequence
  Guide Sequence
gaugagaacugguucuacaugc

SEQ ID NO: 2744 - RNA, 22 nt, Artificial Sequence
  Guide Sequence
gcauguagaaccaguucucauc

SEQ ID NO: 2745 - RNA, 22 nt, Artificial Sequence
  Guide Sequence
gcucgcauguagaaccaguucu

SEQ ID NO: 2746 - RNA, 22 nt, Artificial Sequence
  Guide Sequence
gguucuacaugcgagcugguga

SEQ ID NO: 2747 - RNA, 22 nt, Artificial Sequence
  Guide Sequence
guuccucaccagcucgcaugua

SEQ ID NO: 2748 - RNA, 22 nt, Artificial Sequence
  Guide Sequence
guucuacaugcgagcuggugag

SEQ ID NO: 2749 - RNA, 22 nt, Artificial Sequence
  Guide Sequence
uaaguuccucaccagcucgcau

SEQ ID NO: 2750 - RNA, 22 nt, Artificial Sequence
  Guide Sequence
uacaugcgagcuggugaggaac

SEQ ID NO: 2751 - RNA, 22 nt, Artificial Sequence
  Guide Sequence
uacgaugagaacugguucuaca

SEQ ID NO: 2752 - RNA, 22 nt, Artificial Sequence
  Guide Sequence
ucaccagcucgcauguagaacc

SEQ ID NO: 2753 - RNA, 22 nt, Artificial Sequence
  Guide Sequence
uccucaccagcucgcauguaga

SEQ ID NO: 2754 - RNA, 22 nt, Artificial Sequence
  Guide Sequence
ucgcauguagaaccaguucuca

SEQ ID NO: 2755 - RNA, 22 nt, Artificial Sequence
  Guide Sequence
ucuacaugcgagcuggugagga

SEQ ID NO: 2756 - RNA, 22 nt, Artificial Sequence
  Guide Sequence
ugagaacugguucuacaugcga

SEQ ID NO: 2757 - RNA, 22 nt, Artificial Sequence
  Guide Sequence
ugguucuacaugcgagcuggug

SEQ ID NO: 2758 - RNA, 22 nt, Artificial Sequence
  Guide Sequence
uuccucaccagcucgcauguag

SEQ ID NO: 2759 - RNA, 22 nt, Artificial Sequence
  Guide Sequence
uucuacaugcgagcuggugagg

SEQ ID NO: 2760 - RNA, 20 nt, Artificial Sequence
  Guide Sequence
aaagaccuaaguucgucacc

SEQ ID NO: 2761 - RNA, 20 nt, Artificial Sequence
  Guide Sequence
aagaccuaaguucgucacca

SEQ ID NO: 2762 - RNA, 20 nt, Artificial Sequence
  Guide Sequence
aaguucgucaccagcucgcg

SEQ ID NO: 2763 - RNA, 20 nt, Artificial Sequence
  Guide Sequence
acacgcgagcuggugacgaa

SEQ ID NO: 2764 - RNA, 20 nt, Artificial Sequence
  Guide Sequence
accuaaguucgucaccagcu

SEQ ID NO: 2765 - RNA, 20 nt, Artificial Sequence
  Guide Sequence
acgaacuuaggucuuuggcu

SEQ ID NO: 2766 - RNA, 20 nt, Artificial Sequence
  Guide Sequence
acgcgagcuggugacgaacu

SEQ ID NO: 2767 - RNA, 20 nt, Artificial Sequence
  Guide Sequence
agaccuaaguucgucaccag

SEQ ID NO: 2768 - RNA, 20 nt, Artificial Sequence
  Guide Sequence
agccaaagaccuaaguucgu

SEQ ID NO: 2769 - RNA, 20 nt, Artificial Sequence
  Guide Sequence
agcuggugacgaacuuaggu

SEQ ID NO: 2770 - RNA, 20 nt, Artificial Sequence
  Guide Sequence
aguucgucaccagcucgcgu

SEQ ID NO: 2771 - RNA, 20 nt, Artificial Sequence
  Guide Sequence
caaagaccuaaguucgucac

SEQ ID NO: 2772 - RNA, 20 nt, Artificial Sequence
  Guide Sequence
cacgcgagcuggugacgaac

SEQ ID NO: 2773 - RNA, 20 nt, Artificial Sequence
  Guide Sequence
cagccaaagaccuaaguucg

SEQ ID NO: 2774 - RNA, 20 nt, Artificial Sequence
  Guide Sequence
ccaaagaccuaaguucguca

SEQ ID NO: 2775 - RNA, 20 nt, Artificial Sequence
  Guide Sequence
ccagccaaagaccuaaguuc

SEQ ID NO: 2776 - RNA, 20 nt, Artificial Sequence
  Guide Sequence
ccuaaguucgucaccagcuc

SEQ ID NO: 2777 - RNA, 20 nt, Artificial Sequence
  Guide Sequence
cgagcuggugacgaacuuag

SEQ ID NO: 2778 - RNA, 20 nt, Artificial Sequence
  Guide Sequence
cgcgagcuggugacgaacuu

SEQ ID NO: 2779 - RNA, 20 nt, Artificial Sequence
  Guide Sequence
cgucaccagcucgcguguag

SEQ ID NO: 2780 - RNA, 20 nt, Artificial Sequence
  Guide Sequence
cuaaguucgucaccagcucg

SEQ ID NO: 2781 - RNA, 20 nt, Artificial Sequence
  Guide Sequence
cuacacgcgagcuggugacg

SEQ ID NO: 2782 - RNA, 20 nt, Artificial Sequence
  Guide Sequence
cuccagccaaagaccuaagu

SEQ ID NO: 2783 - RNA, 20 nt, Artificial Sequence
  Guide Sequence
cuggugacgaacuuaggucu

SEQ ID NO: 2784 - RNA, 20 nt, Artificial Sequence
  Guide Sequence
gaccuaaguucgucaccagc

SEQ ID NO: 2785 - RNA, 20 nt, Artificial Sequence
  Guide Sequence
gacgaacuuaggucuuuggc

SEQ ID NO: 2786 - RNA, 20 nt, Artificial Sequence
  Guide Sequence
gagcuggugacgaacuuagg

SEQ ID NO: 2787 - RNA, 20 nt, Artificial Sequence
  Guide Sequence
gccaaagaccuaaguucguc

SEQ ID NO: 2788 - RNA, 20 nt, Artificial Sequence
  Guide Sequence
gcgagcuggugacgaacuua

SEQ ID NO: 2789 - RNA, 20 nt, Artificial Sequence
  Guide Sequence
gcuggugacgaacuuagguc

SEQ ID NO: 2790 - RNA, 20 nt, Artificial Sequence
  Guide Sequence
ggugacgaacuuaggucuuu

SEQ ID NO: 2791 - RNA, 20 nt, Artificial Sequence
  Guide Sequence
gguucuacacgcgagcuggu

SEQ ID NO: 2792 - RNA, 20 nt, Artificial Sequence
  Guide Sequence
gugacgaacuuaggucuuug

SEQ ID NO: 2793 - RNA, 20 nt, Artificial Sequence
  Guide Sequence
guucgucaccagcucgcgug

SEQ ID NO: 2794 - RNA, 20 nt, Artificial Sequence
  Guide Sequence
guucuacacgcgagcuggug

SEQ ID NO: 2795 - RNA, 20 nt, Artificial Sequence
  Guide Sequence
uaaguucgucaccagcucgc

SEQ ID NO: 2796 - RNA, 20 nt, Artificial Sequence
  Guide Sequence
uacacgcgagcuggugacga

SEQ ID NO: 2797 - RNA, 20 nt, Artificial Sequence
  Guide Sequence
uccagccaaagaccuaaguu

SEQ ID NO: 2798 - RNA, 20 nt, Artificial Sequence
  Guide Sequence
ucgucaccagcucgcgugua

SEQ ID NO: 2799 - RNA, 20 nt, Artificial Sequence
  Guide Sequence
ucuacacgcgagcuggugac

SEQ ID NO: 2800 - RNA, 20 nt, Artificial Sequence
  Guide Sequence
ucuccagccaaagaccuaag

SEQ ID NO: 2801 - RNA, 20 nt, Artificial Sequence
  Guide Sequence
ugacgaacuuaggucuuugg

SEQ ID NO: 2802 - RNA, 20 nt, Artificial Sequence
  Guide Sequence
uggugacgaacuuaggucuu

SEQ ID NO: 2803 - RNA, 20 nt, Artificial Sequence
  Guide Sequence
ugguucuacacgcgagcugg

SEQ ID NO: 2804 - RNA, 20 nt, Artificial Sequence
  Guide Sequence
uucgucaccagcucgcgugu

SEQ ID NO: 2805 - RNA, 20 nt, Artificial Sequence
  Guide Sequence
uucuacacgcgagcugguga

SEQ ID NO: 2806 - RNA, 21 nt, Artificial Sequence
  Guide Sequence
aaagaccuaaguucgucacca

SEQ ID NO: 2807 - RNA, 21 nt, Artificial Sequence
  Guide Sequence
aagaccuaaguucgucaccag

SEQ ID NO: 2808 - RNA, 21 nt, Artificial Sequence
  Guide Sequence
aaguucgucaccagcucgcgu

SEQ ID NO: 2809 - RNA, 21 nt, Artificial Sequence
  Guide Sequence
acacgcgagcuggugacgaac

SEQ ID NO: 2810 - RNA, 21 nt, Artificial Sequence
  Guide Sequence
accuaaguucgucaccagcuc

SEQ ID NO: 2811 - RNA, 21 nt, Artificial Sequence
  Guide Sequence
acgaacuuaggucuuuggcug

SEQ ID NO: 2812 - RNA, 21 nt, Artificial Sequence
  Guide Sequence
acgcgagcuggugacgaacuu

SEQ ID NO: 2813 - RNA, 21 nt, Artificial Sequence
  Guide Sequence
agaccuaaguucgucaccagc

SEQ ID NO: 2814 - RNA, 21 nt, Artificial Sequence
  Guide Sequence
agccaaagaccuaaguucguc

SEQ ID NO: 2815 - RNA, 21 nt, Artificial Sequence
  Guide Sequence
agcuggugacgaacuuagguc

SEQ ID NO: 2816 - RNA, 21 nt, Artificial Sequence
  Guide Sequence
aguucgucaccagcucgcgug

SEQ ID NO: 2817 - RNA, 21 nt, Artificial Sequence
  Guide Sequence
caaagaccuaaguucgucacc

SEQ ID NO: 2818 - RNA, 21 nt, Artificial Sequence
  Guide Sequence
cacgcgagcuggugacgaacu

SEQ ID NO: 2819 - RNA, 21 nt, Artificial Sequence
  Guide Sequence
cagccaaagaccuaaguucgu

SEQ ID NO: 2820 - RNA, 21 nt, Artificial Sequence
  Guide Sequence
ccaaagaccuaaguucgucac

SEQ ID NO: 2821 - RNA, 21 nt, Artificial Sequence
  Guide Sequence
ccagccaaagaccuaaguucg

SEQ ID NO: 2822 - RNA, 21 nt, Artificial Sequence
  Guide Sequence
ccuaaguucgucaccagcucg

SEQ ID NO: 2823 - RNA, 21 nt, Artificial Sequence
  Guide Sequence
cgagcuggugacgaacuuagg

SEQ ID NO: 2824 - RNA, 21 nt, Artificial Sequence
  Guide Sequence
cgcgagcuggugacgaacuua

SEQ ID NO: 2825 - RNA, 21 nt, Artificial Sequence
  Guide Sequence
cgucaccagcucgcguguaga

SEQ ID NO: 2826 - RNA, 21 nt, Artificial Sequence
  Guide Sequence
cuaaguucgucaccagcucgc

SEQ ID NO: 2827 - RNA, 21 nt, Artificial Sequence
  Guide Sequence
cuacacgcgagcuggugacga

SEQ ID NO: 2828 - RNA, 21 nt, Artificial Sequence
  Guide Sequence
cuccagccaaagaccuaaguu

SEQ ID NO: 2829 - RNA, 21 nt, Artificial Sequence
  Guide Sequence
cucuccagccaaagaccuaag

SEQ ID NO: 2830 - RNA, 21 nt, Artificial Sequence
  Guide Sequence
cuggugacgaacuuaggucuu

SEQ ID NO: 2831 - RNA, 21 nt, Artificial Sequence
  Guide Sequence
cugguucuacacgcgagcugg

SEQ ID NO: 2832 - RNA, 21 nt, Artificial Sequence
  Guide Sequence
gaccuaaguucgucaccagcu

SEQ ID NO: 2833 - RNA, 21 nt, Artificial Sequence
  Guide Sequence
gacgaacuuaggucuuuggcu

SEQ ID NO: 2834 - RNA, 21 nt, Artificial Sequence
  Guide Sequence
gagcuggugacgaacuuaggu

SEQ ID NO: 2835 - RNA, 21 nt, Artificial Sequence
  Guide Sequence
gccaaagaccuaaguucguca

SEQ ID NO: 2836 - RNA, 21 nt, Artificial Sequence
  Guide Sequence
gcgagcuggugacgaacuuag

SEQ ID NO: 2837 - RNA, 21 nt, Artificial Sequence
  Guide Sequence
gcuggugacgaacuuaggucu

SEQ ID NO: 2838 - RNA, 21 nt, Artificial Sequence
  Guide Sequence
ggugacgaacuuaggucuuug

SEQ ID NO: 2839 - RNA, 21 nt, Artificial Sequence
  Guide Sequence
gguucuacacgcgagcuggug

SEQ ID NO: 2840 - RNA, 21 nt, Artificial Sequence
  Guide Sequence
gugacgaacuuaggucuuugg

SEQ ID NO: 2841 - RNA, 21 nt, Artificial Sequence
  Guide Sequence
guucgucaccagcucgcgugu

SEQ ID NO: 2842 - RNA, 21 nt, Artificial Sequence
  Guide Sequence
guucuacacgcgagcugguga

SEQ ID NO: 2843 - RNA, 21 nt, Artificial Sequence
  Guide Sequence
uaaguucgucaccagcucgcg

SEQ ID NO: 2844 - RNA, 21 nt, Artificial Sequence
  Guide Sequence
uacacgcgagcuggugacgaa

SEQ ID NO: 2845 - RNA, 21 nt, Artificial Sequence
  Guide Sequence
uccagccaaagaccuaaguuc

SEQ ID NO: 2846 - RNA, 21 nt, Artificial Sequence
  Guide Sequence
ucgucaccagcucgcguguag

SEQ ID NO: 2847 - RNA, 21 nt, Artificial Sequence
  Guide Sequence
ucuacacgcgagcuggugacg

SEQ ID NO: 2848 - RNA, 21 nt, Artificial Sequence
  Guide Sequence
ucuccagccaaagaccuaagu

SEQ ID NO: 2849 - RNA, 21 nt, Artificial Sequence
  Guide Sequence
ugacgaacuuaggucuuuggc

SEQ ID NO: 2850 - RNA, 21 nt, Artificial Sequence
  Guide Sequence
uggugacgaacuuaggucuuu

SEQ ID NO: 2851 - RNA, 21 nt, Artificial Sequence
  Guide Sequence
ugguucuacacgcgagcuggu

SEQ ID NO: 2852 - RNA, 21 nt, Artificial Sequence
  Guide Sequence
uucgucaccagcucgcgugua

SEQ ID NO: 2853 - RNA, 21 nt, Artificial Sequence
  Guide Sequence
uucuacacgcgagcuggugac

SEQ ID NO: 2854 - RNA, 22 nt, Artificial Sequence
  Guide Sequence
aaagaccuaaguucgucaccag

SEQ ID NO: 2855 - RNA, 22 nt, Artificial Sequence
  Guide Sequence
aagaccuaaguucgucaccagc

SEQ ID NO: 2856 - RNA, 22 nt, Artificial Sequence
  Guide Sequence
aaguucgucaccagcucgcgug

SEQ ID NO: 2857 - RNA, 22 nt, Artificial Sequence
  Guide Sequence
acacgcgagcuggugacgaacu

SEQ ID NO: 2858 - RNA, 22 nt, Artificial Sequence
  Guide Sequence
accuaaguucgucaccagcucg

SEQ ID NO: 2859 - RNA, 22 nt, Artificial Sequence
  Guide Sequence
acgaacuuaggucuuuggcugg

SEQ ID NO: 2860 - RNA, 22 nt, Artificial Sequence
  Guide Sequence
acgcgagcuggugacgaacuua

SEQ ID NO: 2861 - RNA, 22 nt, Artificial Sequence
  Guide Sequence
acucuccagccaaagaccuaag

SEQ ID NO: 2862 - RNA, 22 nt, Artificial Sequence
  Guide Sequence
acugguucuacacgcgagcugg

SEQ ID NO: 2863 - RNA, 22 nt, Artificial Sequence
  Guide Sequence
agaccuaaguucgucaccagcu

SEQ ID NO: 2864 - RNA, 22 nt, Artificial Sequence
  Guide Sequence
agccaaagaccuaaguucguca

SEQ ID NO: 2865 - RNA, 22 nt, Artificial Sequence
  Guide Sequence
agcuggugacgaacuuaggucu

SEQ ID NO: 2866 - RNA, 22 nt, Artificial Sequence
  Guide Sequence
aguucgucaccagcucgcgugu

SEQ ID NO: 2867 - RNA, 22 nt, Artificial Sequence
  Guide Sequence
caaagaccuaaguucgucacca

SEQ ID NO: 2868 - RNA, 22 nt, Artificial Sequence
  Guide Sequence
cacgcgagcuggugacgaacuu

SEQ ID NO: 2869 - RNA, 22 nt, Artificial Sequence
  Guide Sequence
cagccaaagaccuaaguucguc

SEQ ID NO: 2870 - RNA, 22 nt, Artificial Sequence
  Guide Sequence
ccaaagaccuaaguucgucacc

SEQ ID NO: 2871 - RNA, 22 nt, Artificial Sequence
  Guide Sequence
ccagccaaagaccuaaguucgu

SEQ ID NO: 2872 - RNA, 22 nt, Artificial Sequence
  Guide Sequence
ccuaaguucgucaccagcucgc

SEQ ID NO: 2873 - RNA, 22 nt, Artificial Sequence
  Guide Sequence
cgagcuggugacgaacuuaggu

SEQ ID NO: 2874 - RNA, 22 nt, Artificial Sequence
  Guide Sequence
cgcgagcuggugacgaacuuag

SEQ ID NO: 2875 - RNA, 22 nt, Artificial Sequence
  Guide Sequence
cgucaccagcucgcguguagaa

SEQ ID NO: 2876 - RNA, 22 nt, Artificial Sequence
  Guide Sequence
cuaaguucgucaccagcucgcg

SEQ ID NO: 2877 - RNA, 22 nt, Artificial Sequence
  Guide Sequence
cuacacgcgagcuggugacgaa

SEQ ID NO: 2878 - RNA, 22 nt, Artificial Sequence
  Guide Sequence
cuccagccaaagaccuaaguuc

SEQ ID NO: 2879 - RNA, 22 nt, Artificial Sequence
  Guide Sequence
cucuccagccaaagaccuaagu

SEQ ID NO: 2880 - RNA, 22 nt, Artificial Sequence
  Guide Sequence
cuggugacgaacuuaggucuuu

SEQ ID NO: 2881 - RNA, 22 nt, Artificial Sequence
  Guide Sequence
cugguucuacacgcgagcuggu

SEQ ID NO: 2882 - RNA, 22 nt, Artificial Sequence
  Guide Sequence
gaccuaaguucgucaccagcuc

SEQ ID NO: 2883 - RNA, 22 nt, Artificial Sequence
  Guide Sequence
gacgaacuuaggucuuuggcug

SEQ ID NO: 2884 - RNA, 22 nt, Artificial Sequence
  Guide Sequence
gagcuggugacgaacuuagguc

SEQ ID NO: 2885 - RNA, 22 nt, Artificial Sequence
  Guide Sequence
gccaaagaccuaaguucgucac

SEQ ID NO: 2886 - RNA, 22 nt, Artificial Sequence
  Guide Sequence
gcgagcuggugacgaacuuagg

SEQ ID NO: 2887 - RNA, 22 nt, Artificial Sequence
  Guide Sequence
gcuggugacgaacuuaggucuu

SEQ ID NO: 2888 - RNA, 22 nt, Artificial Sequence
  Guide Sequence
ggugacgaacuuaggucuuugg

SEQ ID NO: 2889 - RNA, 22 nt, Artificial Sequence
  Guide Sequence
gguucuacacgcgagcugguga

SEQ ID NO: 2890 - RNA, 22 nt, Artificial Sequence
  Guide Sequence
gugacgaacuuaggucuuuggc

SEQ ID NO: 2891 - RNA, 22 nt, Artificial Sequence
  Guide Sequence
guucgucaccagcucgcgugua

SEQ ID NO: 2892 - RNA, 22 nt, Artificial Sequence
  Guide Sequence
guucuacacgcgagcuggugac

SEQ ID NO: 2893 - RNA, 22 nt, Artificial Sequence
  Guide Sequence
uaaguucgucaccagcucgcgu

SEQ ID NO: 2894 - RNA, 22 nt, Artificial Sequence
  Guide Sequence
uacacgcgagcuggugacgaac

SEQ ID NO: 2895 - RNA, 22 nt, Artificial Sequence
  Guide Sequence
uccagccaaagaccuaaguucg

SEQ ID NO: 2896 - RNA, 22 nt, Artificial Sequence
  Guide Sequence
ucgucaccagcucgcguguaga

SEQ ID NO: 2897 - RNA, 22 nt, Artificial Sequence
  Guide Sequence
ucuacacgcgagcuggugacga

SEQ ID NO: 2898 - RNA, 22 nt, Artificial Sequence
  Guide Sequence
ucuccagccaaagaccuaaguu

SEQ ID NO: 2899 - RNA, 22 nt, Artificial Sequence
  Guide Sequence
ugacgaacuuaggucuuuggcu

SEQ ID NO: 2900 - RNA, 22 nt, Artificial Sequence
  Guide Sequence
uggugacgaacuuaggucuuug

SEQ ID NO: 2901 - RNA, 22 nt, Artificial Sequence
  Guide Sequence
ugguucuacacgcgagcuggug

SEQ ID NO: 2902 - RNA, 22 nt, Artificial Sequence
  Guide Sequence
uucgucaccagcucgcguguag

SEQ ID NO: 2903 - RNA, 22 nt, Artificial Sequence
  Guide Sequence
uucuacacgcgagcuggugacg

SEQ ID NO: 2904 - RNA, 20 nt, Artificial Sequence
  Guide Sequence
aagccggggguagugugaga

SEQ ID NO: 2905 - RNA, 20 nt, Artificial Sequence
  Guide Sequence
aaucucccucucacacuacc

SEQ ID NO: 2906 - RNA, 20 nt, Artificial Sequence
  Guide Sequence
acacuacccccggcuuccac

SEQ ID NO: 2907 - RNA, 20 nt, Artificial Sequence
  Guide Sequence
acaggugccgcgcuguggaa

SEQ ID NO: 2908 - RNA, 20 nt, Artificial Sequence
  Guide Sequence
acccccggcuuccacagcgc

SEQ ID NO: 2909 - RNA, 20 nt, Artificial Sequence
  Guide Sequence
acuacccccggcuuccacag

SEQ ID NO: 2910 - RNA, 20 nt, Artificial Sequence
  Guide Sequence
agccggggguagugugagag

SEQ ID NO: 2911 - RNA, 20 nt, Artificial Sequence
  Guide Sequence
aggugccgcgcuguggaagc

SEQ ID NO: 2912 - RNA, 20 nt, Artificial Sequence
  Guide Sequence
aucucccucucacacuaccc

SEQ ID NO: 2913 - RNA, 20 nt, Artificial Sequence
  Guide Sequence
cacacuacccccggcuucca

SEQ ID NO: 2914 - RNA, 20 nt, Artificial Sequence
  Guide Sequence
cacuacccccggcuuccaca

SEQ ID NO: 2915 - RNA, 20 nt, Artificial Sequence
  Guide Sequence
caggugccgcgcuguggaag

SEQ ID NO: 2916 - RNA, 20 nt, Artificial Sequence
  Guide Sequence
cccccggcuuccacagcgcg

SEQ ID NO: 2917 - RNA, 20 nt, Artificial Sequence
  Guide Sequence
ccccggcuuccacagcgcgg

SEQ ID NO: 2918 - RNA, 20 nt, Artificial Sequence
  Guide Sequence
cccggcuuccacagcgcggc

SEQ ID NO: 2919 - RNA, 20 nt, Artificial Sequence
  Guide Sequence
cccucucacacuacccccgg

SEQ ID NO: 2920 - RNA, 20 nt, Artificial Sequence
  Guide Sequence
ccgcgcuguggaagccgggg

SEQ ID NO: 2921 - RNA, 20 nt, Artificial Sequence
  Guide Sequence
ccggcuuccacagcgcggca

SEQ ID NO: 2922 - RNA, 20 nt, Artificial Sequence
  Guide Sequence
ccggggguagugugagaggg

SEQ ID NO: 2923 - RNA, 20 nt, Artificial Sequence
  Guide Sequence
ccucucacacuacccccggc

SEQ ID NO: 2924 - RNA, 20 nt, Artificial Sequence
  Guide Sequence
cgcgcuguggaagccggggg

SEQ ID NO: 2925 - RNA, 20 nt, Artificial Sequence
  Guide Sequence
cgcuguggaagccgggggua

SEQ ID NO: 2926 - RNA, 20 nt, Artificial Sequence
  Guide Sequence
cggcuuccacagcgcggcac

SEQ ID NO: 2927 - RNA, 20 nt, Artificial Sequence
  Guide Sequence
cuacccccggcuuccacagc

SEQ ID NO: 2928 - RNA, 20 nt, Artificial Sequence
  Guide Sequence
cucacacuacccccggcuuc

SEQ ID NO: 2929 - RNA, 20 nt, Artificial Sequence
  Guide Sequence
cucccucucacacuaccccc

SEQ ID NO: 2930 - RNA, 20 nt, Artificial Sequence
  Guide Sequence
cucucacacuacccccggcu

SEQ ID NO: 2931 - RNA, 20 nt, Artificial Sequence
  Guide Sequence
cuguggaagccggggguagu

SEQ ID NO: 2932 - RNA, 20 nt, Artificial Sequence
  Guide Sequence
gaagccggggguagugugag

SEQ ID NO: 2933 - RNA, 20 nt, Artificial Sequence
  Guide Sequence
gccgcgcuguggaagccggg

SEQ ID NO: 2934 - RNA, 20 nt, Artificial Sequence
  Guide Sequence
gccggggguagugugagagg

SEQ ID NO: 2935 - RNA, 20 nt, Artificial Sequence
  Guide Sequence
gcgcuguggaagccgggggu

SEQ ID NO: 2936 - RNA, 20 nt, Artificial Sequence
  Guide Sequence
gcuguggaagccggggguag

SEQ ID NO: 2937 - RNA, 20 nt, Artificial Sequence
  Guide Sequence
ggaagccggggguaguguga

SEQ ID NO: 2938 - RNA, 20 nt, Artificial Sequence
  Guide Sequence
ggugccgcgcuguggaagcc

SEQ ID NO: 2939 - RNA, 20 nt, Artificial Sequence
  Guide Sequence
gugccgcgcuguggaagccg

SEQ ID NO: 2940 - RNA, 20 nt, Artificial Sequence
  Guide Sequence
guggaagccggggguagugu

SEQ ID NO: 2941 - RNA, 20 nt, Artificial Sequence
  Guide Sequence
uacaggugccgcgcugugga

SEQ ID NO: 2942 - RNA, 20 nt, Artificial Sequence
  Guide Sequence
uacccccggcuuccacagcg

SEQ ID NO: 2943 - RNA, 20 nt, Artificial Sequence
  Guide Sequence
ucacacuacccccggcuucc

SEQ ID NO: 2944 - RNA, 20 nt, Artificial Sequence
  Guide Sequence
ucccucucacacuacccccg

SEQ ID NO: 2945 - RNA, 20 nt, Artificial Sequence
  Guide Sequence
ucucacacuacccccggcuu

SEQ ID NO: 2946 - RNA, 20 nt, Artificial Sequence
  Guide Sequence
ucucccucucacacuacccc

SEQ ID NO: 2947 - RNA, 20 nt, Artificial Sequence
  Guide Sequence
ugccgcgcuguggaagccgg

SEQ ID NO: 2948 - RNA, 20 nt, Artificial Sequence
  Guide Sequence
uggaagccggggguagugug

SEQ ID NO: 2949 - RNA, 20 nt, Artificial Sequence
  Guide Sequence
uguggaagccggggguagug

SEQ ID NO: 2950 - RNA, 21 nt, Artificial Sequence
  Guide Sequence
aaaucucccucucacacuacc

SEQ ID NO: 2951 - RNA, 21 nt, Artificial Sequence
  Guide Sequence
aagccggggguagugugagag

SEQ ID NO: 2952 - RNA, 21 nt, Artificial Sequence
  Guide Sequence
aaucucccucucacacuaccc

SEQ ID NO: 2953 - RNA, 21 nt, Artificial Sequence
  Guide Sequence
acacuacccccggcuuccaca

SEQ ID NO: 2954 - RNA, 21 nt, Artificial Sequence
  Guide Sequence
acaggugccgcgcuguggaag

SEQ ID NO: 2955 - RNA, 21 nt, Artificial Sequence
  Guide Sequence
acccccggcuuccacagcgcg

SEQ ID NO: 2956 - RNA, 21 nt, Artificial Sequence
  Guide Sequence
acuacccccggcuuccacagc

SEQ ID NO: 2957 - RNA, 21 nt, Artificial Sequence
  Guide Sequence
agccggggguagugugagagg

SEQ ID NO: 2958 - RNA, 21 nt, Artificial Sequence
  Guide Sequence
aggugccgcgcuguggaagcc

SEQ ID NO: 2959 - RNA, 21 nt, Artificial Sequence
  Guide Sequence
aucucccucucacacuacccc

SEQ ID NO: 2960 - RNA, 21 nt, Artificial Sequence
  Guide Sequence
cacacuacccccggcuuccac

SEQ ID NO: 2961 - RNA, 21 nt, Artificial Sequence
  Guide Sequence
cacuacccccggcuuccacag

SEQ ID NO: 2962 - RNA, 21 nt, Artificial Sequence
  Guide Sequence
caggugccgcgcuguggaagc

SEQ ID NO: 2963 - RNA, 21 nt, Artificial Sequence
  Guide Sequence
cccggcuuccacagcgcggca

SEQ ID NO: 2964 - RNA, 21 nt, Artificial Sequence
  Guide Sequence
cccucucacacuacccccggc

SEQ ID NO: 2965 - RNA, 21 nt, Artificial Sequence
  Guide Sequence
ccggcuuccacagcgcggcac

SEQ ID NO: 2966 - RNA, 21 nt, Artificial Sequence
  Guide Sequence
ccggggguagugugagaggga

SEQ ID NO: 2967 - RNA, 21 nt, Artificial Sequence
  Guide Sequence
ccucucacacuacccccggcu

SEQ ID NO: 2968 - RNA, 21 nt, Artificial Sequence
  Guide Sequence
cgcgcuguggaagccgggggu

SEQ ID NO: 2969 - RNA, 21 nt, Artificial Sequence
  Guide Sequence
cgcuguggaagccggggguag

SEQ ID NO: 2970 - RNA, 21 nt, Artificial Sequence
  Guide Sequence
cggcuuccacagcgcggcacc

SEQ ID NO: 2971 - RNA, 21 nt, Artificial Sequence
  Guide Sequence
cuacccccggcuuccacagcg

SEQ ID NO: 2972 - RNA, 21 nt, Artificial Sequence
  Guide Sequence
cucacacuacccccggcuucc

SEQ ID NO: 2973 - RNA, 21 nt, Artificial Sequence
  Guide Sequence
cucccucucacacuacccccg

SEQ ID NO: 2974 - RNA, 21 nt, Artificial Sequence
  Guide Sequence
cucucacacuacccccggcuu

SEQ ID NO: 2975 - RNA, 21 nt, Artificial Sequence
  Guide Sequence
cuguggaagccggggguagug

SEQ ID NO: 2976 - RNA, 21 nt, Artificial Sequence
  Guide Sequence
gaagccggggguagugugaga

SEQ ID NO: 2977 - RNA, 21 nt, Artificial Sequence
  Guide Sequence
gccggggguagugugagaggg

SEQ ID NO: 2978 - RNA, 21 nt, Artificial Sequence
  Guide Sequence
gcgcuguggaagccgggggua

SEQ ID NO: 2979 - RNA, 21 nt, Artificial Sequence
  Guide Sequence
gcuguggaagccggggguagu

SEQ ID NO: 2980 - RNA, 21 nt, Artificial Sequence
  Guide Sequence
ggaagccggggguagugugag

SEQ ID NO: 2981 - RNA, 21 nt, Artificial Sequence
  Guide Sequence
ggugccgcgcuguggaagccg

SEQ ID NO: 2982 - RNA, 21 nt, Artificial Sequence
  Guide Sequence
guacaggugccgcgcugugga

SEQ ID NO: 2983 - RNA, 21 nt, Artificial Sequence
  Guide Sequence
gugccgcgcuguggaagccgg

SEQ ID NO: 2984 - RNA, 21 nt, Artificial Sequence
  Guide Sequence
guggaagccggggguagugug

SEQ ID NO: 2985 - RNA, 21 nt, Artificial Sequence
  Guide Sequence
uacaggugccgcgcuguggaa

SEQ ID NO: 2986 - RNA, 21 nt, Artificial Sequence
  Guide Sequence
uacccccggcuuccacagcgc

SEQ ID NO: 2987 - RNA, 21 nt, Artificial Sequence
  Guide Sequence
ucacacuacccccggcuucca

SEQ ID NO: 2988 - RNA, 21 nt, Artificial Sequence
  Guide Sequence
ucccucucacacuacccccgg

SEQ ID NO: 2989 - RNA, 21 nt, Artificial Sequence
  Guide Sequence
ucucacacuacccccggcuuc

SEQ ID NO: 2990 - RNA, 21 nt, Artificial Sequence
  Guide Sequence
ucucccucucacacuaccccc

SEQ ID NO: 2991 - RNA, 21 nt, Artificial Sequence
  Guide Sequence
ugccgcgcuguggaagccggg

SEQ ID NO: 2992 - RNA, 21 nt, Artificial Sequence
  Guide Sequence
uggaagccggggguaguguga

SEQ ID NO: 2993 - RNA, 21 nt, Artificial Sequence
  Guide Sequence
uguggaagccggggguagugu

SEQ ID NO: 2994 - RNA, 22 nt, Artificial Sequence
  Guide Sequence
aaaucucccucucacacuaccc

SEQ ID NO: 2995 - RNA, 22 nt, Artificial Sequence
  Guide Sequence
aagccggggguagugugagagg

SEQ ID NO: 2996 - RNA, 22 nt, Artificial Sequence
  Guide Sequence
aaucucccucucacacuacccc

SEQ ID NO: 2997 - RNA, 22 nt, Artificial Sequence
  Guide Sequence
acacuacccccggcuuccacag

SEQ ID NO: 2998 - RNA, 22 nt, Artificial Sequence
  Guide Sequence
acaggugccgcgcuguggaagc

SEQ ID NO: 2999 - RNA, 22 nt, Artificial Sequence
  Guide Sequence
acccccggcuuccacagcgcgg

SEQ ID NO: 3000 - RNA, 22 nt, Artificial Sequence
  Guide Sequence
acuacccccggcuuccacagcg

SEQ ID NO: 3001 - RNA, 22 nt, Artificial Sequence
  Guide Sequence
agccggggguagugugagaggg

SEQ ID NO: 3002 - RNA, 22 nt, Artificial Sequence
  Guide Sequence
aggugccgcgcuguggaagccg

SEQ ID NO: 3003 - RNA, 22 nt, Artificial Sequence
  Guide Sequence
aucucccucucacacuaccccc

SEQ ID NO: 3004 - RNA, 22 nt, Artificial Sequence
  Guide Sequence
cacacuacccccggcuuccaca

SEQ ID NO: 3005 - RNA, 22 nt, Artificial Sequence
  Guide Sequence
cacuacccccggcuuccacagc

SEQ ID NO: 3006 - RNA, 22 nt, Artificial Sequence
  Guide Sequence
caggugccgcgcuguggaagcc

SEQ ID NO: 3007 - RNA, 22 nt, Artificial Sequence
  Guide Sequence
ccccggcuuccacagcgcggca

SEQ ID NO: 3008 - RNA, 22 nt, Artificial Sequence
  Guide Sequence
cccggcuuccacagcgcggcac

SEQ ID NO: 3009 - RNA, 22 nt, Artificial Sequence
  Guide Sequence
cccucucacacuacccccggcu

SEQ ID NO: 3010 - RNA, 22 nt, Artificial Sequence
  Guide Sequence
ccgcgcuguggaagccgggggu

SEQ ID NO: 3011 - RNA, 22 nt, Artificial Sequence
  Guide Sequence
ccggcuuccacagcgcggcacc

SEQ ID NO: 3012 - RNA, 22 nt, Artificial Sequence
  Guide Sequence
ccggggguagugugagagggag

SEQ ID NO: 3013 - RNA, 22 nt, Artificial Sequence
  Guide Sequence
ccucucacacuacccccggcuu

SEQ ID NO: 3014 - RNA, 22 nt, Artificial Sequence
  Guide Sequence
cgcgcuguggaagccgggggua

SEQ ID NO: 3015 - RNA, 22 nt, Artificial Sequence
  Guide Sequence
cgcuguggaagccggggguagu

SEQ ID NO: 3016 - RNA, 22 nt, Artificial Sequence
  Guide Sequence
cggcuuccacagcgcggcaccu

SEQ ID NO: 3017 - RNA, 22 nt, Artificial Sequence
  Guide Sequence
cuacccccggcuuccacagcgc

SEQ ID NO: 3018 - RNA, 22 nt, Artificial Sequence
  Guide Sequence
cucacacuacccccggcuucca

SEQ ID NO: 3019 - RNA, 22 nt, Artificial Sequence
  Guide Sequence
cucccucucacacuacccccgg

SEQ ID NO: 3020 - RNA, 22 nt, Artificial Sequence
  Guide Sequence
cucucacacuacccccggcuuc

SEQ ID NO: 3021 - RNA, 22 nt, Artificial Sequence
  Guide Sequence
cuguggaagccggggguagugu

SEQ ID NO: 3022 - RNA, 22 nt, Artificial Sequence
  Guide Sequence
gaagccggggguagugugagag

SEQ ID NO: 3023 - RNA, 22 nt, Artificial Sequence
  Guide Sequence
gccggggguagugugagaggga

SEQ ID NO: 3024 - RNA, 22 nt, Artificial Sequence
  Guide Sequence
gcgcuguggaagccggggguag

SEQ ID NO: 3025 - RNA, 22 nt, Artificial Sequence
  Guide Sequence
gcuguggaagccggggguagug

SEQ ID NO: 3026 - RNA, 22 nt, Artificial Sequence
  Guide Sequence
ggaagccggggguagugugaga

SEQ ID NO: 3027 - RNA, 22 nt, Artificial Sequence
  Guide Sequence
gguacaggugccgcgcugugga

SEQ ID NO: 3028 - RNA, 22 nt, Artificial Sequence
  Guide Sequence
ggugccgcgcuguggaagccgg

SEQ ID NO: 3029 - RNA, 22 nt, Artificial Sequence
  Guide Sequence
guacaggugccgcgcuguggaa

SEQ ID NO: 3030 - RNA, 22 nt, Artificial Sequence
  Guide Sequence
gugccgcgcuguggaagccggg

SEQ ID NO: 3031 - RNA, 22 nt, Artificial Sequence
  Guide Sequence
guggaagccggggguaguguga

SEQ ID NO: 3032 - RNA, 22 nt, Artificial Sequence
  Guide Sequence
uaaaucucccucucacacuacc

SEQ ID NO: 3033 - RNA, 22 nt, Artificial Sequence
  Guide Sequence
uacaggugccgcgcuguggaag

SEQ ID NO: 3034 - RNA, 22 nt, Artificial Sequence
  Guide Sequence
uacccccggcuuccacagcgcg

SEQ ID NO: 3035 - RNA, 22 nt, Artificial Sequence
  Guide Sequence
ucacacuacccccggcuuccac

SEQ ID NO: 3036 - RNA, 22 nt, Artificial Sequence
  Guide Sequence
ucccucucacacuacccccggc

SEQ ID NO: 3037 - RNA, 22 nt, Artificial Sequence
  Guide Sequence
ucucacacuacccccggcuucc

SEQ ID NO: 3038 - RNA, 22 nt, Artificial Sequence
  Guide Sequence
ucucccucucacacuacccccg

SEQ ID NO: 3039 - RNA, 22 nt, Artificial Sequence
  Guide Sequence
ugccgcgcuguggaagccgggg

SEQ ID NO: 3040 - RNA, 22 nt, Artificial Sequence
  Guide Sequence
uggaagccggggguagugugag

SEQ ID NO: 3041 - RNA, 22 nt, Artificial Sequence
  Guide Sequence
uguggaagccggggguagugug

SEQ ID NO: 3042 - RNA, 20 nt, Artificial Sequence
  Guide Sequence
acacuacccccagcucucac

SEQ ID NO: 3043 - RNA, 20 nt, Artificial Sequence
  Guide Sequence
acaggugccgcgcugugaga

SEQ ID NO: 3044 - RNA, 20 nt, Artificial Sequence
  Guide Sequence
acccccagcucucacagcgc

SEQ ID NO: 3045 - RNA, 20 nt, Artificial Sequence
  Guide Sequence
acuacccccagcucucacag

SEQ ID NO: 3046 - RNA, 20 nt, Artificial Sequence
  Guide Sequence
agagcuggggguagugugag

SEQ ID NO: 3047 - RNA, 20 nt, Artificial Sequence
  Guide Sequence
agcucucacagcgcggcacc

SEQ ID NO: 3048 - RNA, 20 nt, Artificial Sequence
  Guide Sequence
agguacaggugccgcgcugu

SEQ ID NO: 3049 - RNA, 20 nt, Artificial Sequence
  Guide Sequence
aggugccgcgcugugagagc

SEQ ID NO: 3050 - RNA, 20 nt, Artificial Sequence
  Guide Sequence
cacacuacccccagcucuca

SEQ ID NO: 3051 - RNA, 20 nt, Artificial Sequence
  Guide Sequence
cacuacccccagcucucaca

SEQ ID NO: 3052 - RNA, 20 nt, Artificial Sequence
  Guide Sequence
cagcucucacagcgcggcac

SEQ ID NO: 3053 - RNA, 20 nt, Artificial Sequence
  Guide Sequence
caggugccgcgcugugagag

SEQ ID NO: 3054 - RNA, 20 nt, Artificial Sequence
  Guide Sequence
ccagcucucacagcgcggca

SEQ ID NO: 3055 - RNA, 20 nt, Artificial Sequence
  Guide Sequence
cccagcucucacagcgcggc

SEQ ID NO: 3056 - RNA, 20 nt, Artificial Sequence
  Guide Sequence
ccccagcucucacagcgcgg

SEQ ID NO: 3057 - RNA, 20 nt, Artificial Sequence
  Guide Sequence
cccccagcucucacagcgcg

SEQ ID NO: 3058 - RNA, 20 nt, Artificial Sequence
  Guide Sequence
cccucucacacuacccccag

SEQ ID NO: 3059 - RNA, 20 nt, Artificial Sequence
  Guide Sequence
ccgcgcugugagagcugggg

SEQ ID NO: 3060 - RNA, 20 nt, Artificial Sequence
  Guide Sequence
ccucucacacuacccccagc

SEQ ID NO: 3061 - RNA, 20 nt, Artificial Sequence
  Guide Sequence
cgcgcugugagagcuggggg

SEQ ID NO: 3062 - RNA, 20 nt, Artificial Sequence
  Guide Sequence
cgcugugagagcugggggua

SEQ ID NO: 3063 - RNA, 20 nt, Artificial Sequence
  Guide Sequence
cuacccccagcucucacagc

SEQ ID NO: 3064 - RNA, 20 nt, Artificial Sequence
  Guide Sequence
cucacacuacccccagcucu

SEQ ID NO: 3065 - RNA, 20 nt, Artificial Sequence
  Guide Sequence
cucucacacuacccccagcu

SEQ ID NO: 3066 - RNA, 20 nt, Artificial Sequence
  Guide Sequence
cucucacagcgcggcaccug

SEQ ID NO: 3067 - RNA, 20 nt, Artificial Sequence
  Guide Sequence
cugugagagcuggggguagu

SEQ ID NO: 3068 - RNA, 20 nt, Artificial Sequence
  Guide Sequence
gagagcuggggguaguguga

SEQ ID NO: 3069 - RNA, 20 nt, Artificial Sequence
  Guide Sequence
gagguacaggugccgcgcug

SEQ ID NO: 3070 - RNA, 20 nt, Artificial Sequence
  Guide Sequence
gccgcgcugugagagcuggg

SEQ ID NO: 3071 - RNA, 20 nt, Artificial Sequence
  Guide Sequence
gcgcugugagagcugggggu

SEQ ID NO: 3072 - RNA, 20 nt, Artificial Sequence
  Guide Sequence
gcucucacagcgcggcaccu

SEQ ID NO: 3073 - RNA, 20 nt, Artificial Sequence
  Guide Sequence
gcugugagagcuggggguag

SEQ ID NO: 3074 - RNA, 20 nt, Artificial Sequence
  Guide Sequence
gguacaggugccgcgcugug

SEQ ID NO: 3075 - RNA, 20 nt, Artificial Sequence
  Guide Sequence
ggugccgcgcugugagagcu

SEQ ID NO: 3076 - RNA, 20 nt, Artificial Sequence
  Guide Sequence
guacaggugccgcgcuguga

SEQ ID NO: 3077 - RNA, 20 nt, Artificial Sequence
  Guide Sequence
gugagagcuggggguagugu

SEQ ID NO: 3078 - RNA, 20 nt, Artificial Sequence
  Guide Sequence
gugccgcgcugugagagcug

SEQ ID NO: 3079 - RNA, 20 nt, Artificial Sequence
  Guide Sequence
uacaggugccgcgcugugag

SEQ ID NO: 3080 - RNA, 20 nt, Artificial Sequence
  Guide Sequence
uacccccagcucucacagcg

SEQ ID NO: 3081 - RNA, 20 nt, Artificial Sequence
  Guide Sequence
ucacacuacccccagcucuc

SEQ ID NO: 3082 - RNA, 20 nt, Artificial Sequence
  Guide Sequence
ucccucucacacuaccccca

SEQ ID NO: 3083 - RNA, 20 nt, Artificial Sequence
  Guide Sequence
ucucacacuacccccagcuc

SEQ ID NO: 3084 - RNA, 20 nt, Artificial Sequence
  Guide Sequence
ucucacagcgcggcaccugu

SEQ ID NO: 3085 - RNA, 20 nt, Artificial Sequence
  Guide Sequence
ugagagcuggggguagugug

SEQ ID NO: 3086 - RNA, 20 nt, Artificial Sequence
  Guide Sequence
ugccgcgcugugagagcugg

SEQ ID NO: 3087 - RNA, 20 nt, Artificial Sequence
  Guide Sequence
ugugagagcuggggguagug

SEQ ID NO: 3088 - RNA, 21 nt, Artificial Sequence
  Guide Sequence
acacuacccccagcucucaca

SEQ ID NO: 3089 - RNA, 21 nt, Artificial Sequence
  Guide Sequence
acaggugccgcgcugugagag

SEQ ID NO: 3090 - RNA, 21 nt, Artificial Sequence
  Guide Sequence
acccccagcucucacagcgcg

SEQ ID NO: 3091 - RNA, 21 nt, Artificial Sequence
  Guide Sequence
acuacccccagcucucacagc

SEQ ID NO: 3092 - RNA, 21 nt, Artificial Sequence
  Guide Sequence
agagcuggggguagugugaga

SEQ ID NO: 3093 - RNA, 21 nt, Artificial Sequence
  Guide Sequence
agcucucacagcgcggcaccu

SEQ ID NO: 3094 - RNA, 21 nt, Artificial Sequence
  Guide Sequence
agguacaggugccgcgcugug

SEQ ID NO: 3095 - RNA, 21 nt, Artificial Sequence
  Guide Sequence
aggugccgcgcugugagagcu

SEQ ID NO: 3096 - RNA, 21 nt, Artificial Sequence
  Guide Sequence
cacacuacccccagcucucac

SEQ ID NO: 3097 - RNA, 21 nt, Artificial Sequence
  Guide Sequence
cacuacccccagcucucacag

SEQ ID NO: 3098 - RNA, 21 nt, Artificial Sequence
  Guide Sequence
cagcucucacagcgcggcacc

SEQ ID NO: 3099 - RNA, 21 nt, Artificial Sequence
  Guide Sequence
caggugccgcgcugugagagc

SEQ ID NO: 3100 - RNA, 21 nt, Artificial Sequence
  Guide Sequence
ccagcucucacagcgcggcac

SEQ ID NO: 3101 - RNA, 21 nt, Artificial Sequence
  Guide Sequence
cccagcucucacagcgcggca

SEQ ID NO: 3102 - RNA, 21 nt, Artificial Sequence
  Guide Sequence
ccccagcucucacagcgcggc

SEQ ID NO: 3103 - RNA, 21 nt, Artificial Sequence
  Guide Sequence
cccccagcucucacagcgcgg

SEQ ID NO: 3104 - RNA, 21 nt, Artificial Sequence
  Guide Sequence
cccucucacacuacccccagc

SEQ ID NO: 3105 - RNA, 21 nt, Artificial Sequence
  Guide Sequence
ccgcgcugugagagcuggggg

SEQ ID NO: 3106 - RNA, 21 nt, Artificial Sequence
  Guide Sequence
ccucucacacuacccccagcu

SEQ ID NO: 3107 - RNA, 21 nt, Artificial Sequence
  Guide Sequence
cgcgcugugagagcugggggu

SEQ ID NO: 3108 - RNA, 21 nt, Artificial Sequence
  Guide Sequence
cgcugugagagcuggggguag

SEQ ID NO: 3109 - RNA, 21 nt, Artificial Sequence
  Guide Sequence
cuacccccagcucucacagcg

SEQ ID NO: 3110 - RNA, 21 nt, Artificial Sequence
  Guide Sequence
cucacacuacccccagcucuc

SEQ ID NO: 3111 - RNA, 21 nt, Artificial Sequence
  Guide Sequence
cucccucucacacuaccccca

SEQ ID NO: 3112 - RNA, 21 nt, Artificial Sequence
  Guide Sequence
cucucacacuacccccagcuc

SEQ ID NO: 3113 - RNA, 21 nt, Artificial Sequence
  Guide Sequence
cucucacagcgcggcaccugu

SEQ ID NO: 3114 - RNA, 21 nt, Artificial Sequence
  Guide Sequence
cugugagagcuggggguagug

SEQ ID NO: 3115 - RNA, 21 nt, Artificial Sequence
  Guide Sequence
gagagcuggggguagugugag

SEQ ID NO: 3116 - RNA, 21 nt, Artificial Sequence
  Guide Sequence
gagguacaggugccgcgcugu

SEQ ID NO: 3117 - RNA, 21 nt, Artificial Sequence
  Guide Sequence
gccgcgcugugagagcugggg

SEQ ID NO: 3118 - RNA, 21 nt, Artificial Sequence
  Guide Sequence
gcgcugugagagcugggggua

SEQ ID NO: 3119 - RNA, 21 nt, Artificial Sequence
  Guide Sequence
gcucucacagcgcggcaccug

SEQ ID NO: 3120 - RNA, 21 nt, Artificial Sequence
  Guide Sequence
gcugugagagcuggggguagu

SEQ ID NO: 3121 - RNA, 21 nt, Artificial Sequence
  Guide Sequence
ggagguacaggugccgcgcug

SEQ ID NO: 3122 - RNA, 21 nt, Artificial Sequence
  Guide Sequence
gguacaggugccgcgcuguga

SEQ ID NO: 3123 - RNA, 21 nt, Artificial Sequence
  Guide Sequence
ggugccgcgcugugagagcug

SEQ ID NO: 3124 - RNA, 21 nt, Artificial Sequence
  Guide Sequence
guacaggugccgcgcugugag

SEQ ID NO: 3125 - RNA, 21 nt, Artificial Sequence
  Guide Sequence
gugagagcuggggguagugug

SEQ ID NO: 3126 - RNA, 21 nt, Artificial Sequence
  Guide Sequence
gugccgcgcugugagagcugg

SEQ ID NO: 3127 - RNA, 21 nt, Artificial Sequence
  Guide Sequence
uacaggugccgcgcugugaga

SEQ ID NO: 3128 - RNA, 21 nt, Artificial Sequence
  Guide Sequence
uacccccagcucucacagcgc

SEQ ID NO: 3129 - RNA, 21 nt, Artificial Sequence
  Guide Sequence
ucacacuacccccagcucuca

SEQ ID NO: 3130 - RNA, 21 nt, Artificial Sequence
  Guide Sequence
ucccucucacacuacccccag

SEQ ID NO: 3131 - RNA, 21 nt, Artificial Sequence
  Guide Sequence
ucucacacuacccccagcucu

SEQ ID NO: 3132 - RNA, 21 nt, Artificial Sequence
  Guide Sequence
ucucacagcgcggcaccugua

SEQ ID NO: 3133 - RNA, 21 nt, Artificial Sequence
  Guide Sequence
ugagagcuggggguaguguga

SEQ ID NO: 3134 - RNA, 21 nt, Artificial Sequence
  Guide Sequence
ugccgcgcugugagagcuggg

SEQ ID NO: 3135 - RNA, 21 nt, Artificial Sequence
  Guide Sequence
ugugagagcuggggguagugu

SEQ ID NO: 3136 - RNA, 22 nt, Artificial Sequence
  Guide Sequence
acacuacccccagcucucacag

SEQ ID NO: 3137 - RNA, 22 nt, Artificial Sequence
  Guide Sequence
acaggugccgcgcugugagagc

SEQ ID NO: 3138 - RNA, 22 nt, Artificial Sequence
  Guide Sequence
acccccagcucucacagcgcgg

SEQ ID NO: 3139 - RNA, 22 nt, Artificial Sequence
  Guide Sequence
acuacccccagcucucacagcg

SEQ ID NO: 3140 - RNA, 22 nt, Artificial Sequence
  Guide Sequence
agagcuggggguagugugagag

SEQ ID NO: 3141 - RNA, 22 nt, Artificial Sequence
  Guide Sequence
agcucucacagcgcggcaccug

SEQ ID NO: 3142 - RNA, 22 nt, Artificial Sequence
  Guide Sequence
agguacaggugccgcgcuguga

SEQ ID NO: 3143 - RNA, 22 nt, Artificial Sequence
  Guide Sequence
aggugccgcgcugugagagcug

SEQ ID NO: 3144 - RNA, 22 nt, Artificial Sequence
  Guide Sequence
cacacuacccccagcucucaca

SEQ ID NO: 3145 - RNA, 22 nt, Artificial Sequence
  Guide Sequence
cacuacccccagcucucacagc

SEQ ID NO: 3146 - RNA, 22 nt, Artificial Sequence
  Guide Sequence
cagcucucacagcgcggcaccu

SEQ ID NO: 3147 - RNA, 22 nt, Artificial Sequence
  Guide Sequence
caggugccgcgcugugagagcu

SEQ ID NO: 3148 - RNA, 22 nt, Artificial Sequence
  Guide Sequence
ccagcucucacagcgcggcacc

SEQ ID NO: 3149 - RNA, 22 nt, Artificial Sequence
  Guide Sequence
cccagcucucacagcgcggcac

SEQ ID NO: 3150 - RNA, 22 nt, Artificial Sequence
  Guide Sequence
ccccagcucucacagcgcggca

SEQ ID NO: 3151 - RNA, 22 nt, Artificial Sequence
  Guide Sequence
cccccagcucucacagcgcggc

SEQ ID NO: 3152 - RNA, 22 nt, Artificial Sequence
  Guide Sequence
cccucucacacuacccccagcu

SEQ ID NO: 3153 - RNA, 22 nt, Artificial Sequence
  Guide Sequence
ccgcgcugugagagcugggggu

SEQ ID NO: 3154 - RNA, 22 nt, Artificial Sequence
  Guide Sequence
ccucucacacuacccccagcuc

SEQ ID NO: 3155 - RNA, 22 nt, Artificial Sequence
  Guide Sequence
cgcgcugugagagcugggggua

SEQ ID NO: 3156 - RNA, 22 nt, Artificial Sequence
  Guide Sequence
cgcugugagagcuggggguagu

SEQ ID NO: 3157 - RNA, 22 nt, Artificial Sequence
  Guide Sequence
cggagguacaggugccgcgcug

SEQ ID NO: 3158 - RNA, 22 nt, Artificial Sequence
  Guide Sequence
cuacccccagcucucacagcgc

SEQ ID NO: 3159 - RNA, 22 nt, Artificial Sequence
  Guide Sequence
cucacacuacccccagcucuca

SEQ ID NO: 3160 - RNA, 22 nt, Artificial Sequence
  Guide Sequence
cucccucucacacuacccccag

SEQ ID NO: 3161 - RNA, 22 nt, Artificial Sequence
  Guide Sequence
cucucacacuacccccagcucu

SEQ ID NO: 3162 - RNA, 22 nt, Artificial Sequence
  Guide Sequence
cucucacagcgcggcaccugua

SEQ ID NO: 3163 - RNA, 22 nt, Artificial Sequence
  Guide Sequence
cugugagagcuggggguagugu

SEQ ID NO: 3164 - RNA, 22 nt, Artificial Sequence
  Guide Sequence
gagagcuggggguagugugaga

SEQ ID NO: 3165 - RNA, 22 nt, Artificial Sequence
  Guide Sequence
gagguacaggugccgcgcugug

SEQ ID NO: 3166 - RNA, 22 nt, Artificial Sequence
  Guide Sequence
gccgcgcugugagagcuggggg

SEQ ID NO: 3167 - RNA, 22 nt, Artificial Sequence
  Guide Sequence
gcgcugugagagcuggggguag

SEQ ID NO: 3168 - RNA, 22 nt, Artificial Sequence
  Guide Sequence
gcucucacagcgcggcaccugu

SEQ ID NO: 3169 - RNA, 22 nt, Artificial Sequence
  Guide Sequence
gcugugagagcuggggguagug

SEQ ID NO: 3170 - RNA, 22 nt, Artificial Sequence
  Guide Sequence
ggagguacaggugccgcgcugu

SEQ ID NO: 3171 - RNA, 22 nt, Artificial Sequence
  Guide Sequence
gguacaggugccgcgcugugag

SEQ ID NO: 3172 - RNA, 22 nt, Artificial Sequence
  Guide Sequence
ggugccgcgcugugagagcugg

SEQ ID NO: 3173 - RNA, 22 nt, Artificial Sequence
  Guide Sequence
guacaggugccgcgcugugaga

SEQ ID NO: 3174 - RNA, 22 nt, Artificial Sequence
  Guide Sequence
gugagagcuggggguaguguga

SEQ ID NO: 3175 - RNA, 22 nt, Artificial Sequence
  Guide Sequence
gugccgcgcugugagagcuggg

SEQ ID NO: 3176 - RNA, 22 nt, Artificial Sequence
  Guide Sequence
uacaggugccgcgcugugagag

SEQ ID NO: 3177 - RNA, 22 nt, Artificial Sequence
  Guide Sequence
uacccccagcucucacagcgcg

SEQ ID NO: 3178 - RNA, 22 nt, Artificial Sequence
  Guide Sequence
ucacacuacccccagcucucac

SEQ ID NO: 3179 - RNA, 22 nt, Artificial Sequence
  Guide Sequence
ucccucucacacuacccccagc

SEQ ID NO: 3180 - RNA, 22 nt, Artificial Sequence
  Guide Sequence
ucucacacuacccccagcucuc

SEQ ID NO: 3181 - RNA, 22 nt, Artificial Sequence
  Guide Sequence
ucucacagcgcggcaccuguac

SEQ ID NO: 3182 - RNA, 22 nt, Artificial Sequence
  Guide Sequence
ucucccucucacacuaccccca

SEQ ID NO: 3183 - RNA, 22 nt, Artificial Sequence
  Guide Sequence
ugagagcuggggguagugugag

SEQ ID NO: 3184 - RNA, 22 nt, Artificial Sequence
  Guide Sequence
ugccgcgcugugagagcugggg

SEQ ID NO: 3185 - RNA, 22 nt, Artificial Sequence
  Guide Sequence
ugugagagcuggggguagugug

SEQ ID NO: 3186 - RNA, 20 nt, Artificial Sequence
  Guide Sequence
acacuacccccagcuucccc

SEQ ID NO: 3187 - RNA, 20 nt, Artificial Sequence
  Guide Sequence
acaggugccgcgcuggggaa

SEQ ID NO: 3188 - RNA, 20 nt, Artificial Sequence
  Guide Sequence
acccccagcuuccccagcgc

SEQ ID NO: 3189 - RNA, 20 nt, Artificial Sequence
  Guide Sequence
acuacccccagcuuccccag

SEQ ID NO: 3190 - RNA, 20 nt, Artificial Sequence
  Guide Sequence
agcuuccccagcgcggcacc

SEQ ID NO: 3191 - RNA, 20 nt, Artificial Sequence
  Guide Sequence
agguacaggugccgcgcugg

SEQ ID NO: 3192 - RNA, 20 nt, Artificial Sequence
  Guide Sequence
aggugccgcgcuggggaagc

SEQ ID NO: 3193 - RNA, 20 nt, Artificial Sequence
  Guide Sequence
cacacuacccccagcuuccc

SEQ ID NO: 3194 - RNA, 20 nt, Artificial Sequence
  Guide Sequence
cacuacccccagcuucccca

SEQ ID NO: 3195 - RNA, 20 nt, Artificial Sequence
  Guide Sequence
cagcuuccccagcgcggcac

SEQ ID NO: 3196 - RNA, 20 nt, Artificial Sequence
  Guide Sequence
caggugccgcgcuggggaag

SEQ ID NO: 3197 - RNA, 20 nt, Artificial Sequence
  Guide Sequence
ccagcuuccccagcgcggca

SEQ ID NO: 3198 - RNA, 20 nt, Artificial Sequence
  Guide Sequence
cccagcgcggcaccuguacc

SEQ ID NO: 3199 - RNA, 20 nt, Artificial Sequence
  Guide Sequence
cccagcuuccccagcgcggc

SEQ ID NO: 3200 - RNA, 20 nt, Artificial Sequence
  Guide Sequence
ccccagcgcggcaccuguac

SEQ ID NO: 3201 - RNA, 20 nt, Artificial Sequence
  Guide Sequence
ccccagcuuccccagcgcgg

SEQ ID NO: 3202 - RNA, 20 nt, Artificial Sequence
  Guide Sequence
cccccagcuuccccagcgcg

SEQ ID NO: 3203 - RNA, 20 nt, Artificial Sequence
  Guide Sequence
ccgcgcuggggaagcugggg

SEQ ID NO: 3204 - RNA, 20 nt, Artificial Sequence
  Guide Sequence
ccggagguacaggugccgcg

SEQ ID NO: 3205 - RNA, 20 nt, Artificial Sequence
  Guide Sequence
cgcgcuggggaagcuggggg

SEQ ID NO: 3206 - RNA, 20 nt, Artificial Sequence
  Guide Sequence
cgcuggggaagcugggggua

SEQ ID NO: 3207 - RNA, 20 nt, Artificial Sequence
  Guide Sequence
cggagguacaggugccgcgc

SEQ ID NO: 3208 - RNA, 20 nt, Artificial Sequence
  Guide Sequence
cuacccccagcuuccccagc

SEQ ID NO: 3209 - RNA, 20 nt, Artificial Sequence
  Guide Sequence
cucacacuacccccagcuuc

SEQ ID NO: 3210 - RNA, 20 nt, Artificial Sequence
  Guide Sequence
cuggggaagcuggggguagu

SEQ ID NO: 3211 - RNA, 20 nt, Artificial Sequence
  Guide Sequence
cuuccccagcgcggcaccug

SEQ ID NO: 3212 - RNA, 20 nt, Artificial Sequence
  Guide Sequence
gccgcgcuggggaagcuggg

SEQ ID NO: 3213 - RNA, 20 nt, Artificial Sequence
  Guide Sequence
gcgcuggggaagcugggggu

SEQ ID NO: 3214 - RNA, 20 nt, Artificial Sequence
  Guide Sequence
gcuggggaagcuggggguag

SEQ ID NO: 3215 - RNA, 20 nt, Artificial Sequence
  Guide Sequence
gcuuccccagcgcggcaccu

SEQ ID NO: 3216 - RNA, 20 nt, Artificial Sequence
  Guide Sequence
ggagguacaggugccgcgcu

SEQ ID NO: 3217 - RNA, 20 nt, Artificial Sequence
  Guide Sequence
ggggaagcuggggguagugu

SEQ ID NO: 3218 - RNA, 20 nt, Artificial Sequence
  Guide Sequence
gguacaggugccgcgcuggg

SEQ ID NO: 3219 - RNA, 20 nt, Artificial Sequence
  Guide Sequence
ggugccgcgcuggggaagcu

SEQ ID NO: 3220 - RNA, 20 nt, Artificial Sequence
  Guide Sequence
guacaggugccgcgcugggg

SEQ ID NO: 3221 - RNA, 20 nt, Artificial Sequence
  Guide Sequence
gugccgcgcuggggaagcug

SEQ ID NO: 3222 - RNA, 20 nt, Artificial Sequence
  Guide Sequence
uacaggugccgcgcugggga

SEQ ID NO: 3223 - RNA, 20 nt, Artificial Sequence
  Guide Sequence
uacccccagcuuccccagcg

SEQ ID NO: 3224 - RNA, 20 nt, Artificial Sequence
  Guide Sequence
ucacacuacccccagcuucc

SEQ ID NO: 3225 - RNA, 20 nt, Artificial Sequence
  Guide Sequence
uccccagcgcggcaccugua

SEQ ID NO: 3226 - RNA, 20 nt, Artificial Sequence
  Guide Sequence
ucucacacuacccccagcuu

SEQ ID NO: 3227 - RNA, 20 nt, Artificial Sequence
  Guide Sequence
ugccgcgcuggggaagcugg

SEQ ID NO: 3228 - RNA, 20 nt, Artificial Sequence
  Guide Sequence
uggggaagcuggggguagug

SEQ ID NO: 3229 - RNA, 20 nt, Artificial Sequence
  Guide Sequence
uuccccagcgcggcaccugu

SEQ ID NO: 3230 - RNA, 21 nt, Artificial Sequence
  Guide Sequence
acacuacccccagcuucccca

SEQ ID NO: 3231 - RNA, 21 nt, Artificial Sequence
  Guide Sequence
acaggugccgcgcuggggaag

SEQ ID NO: 3232 - RNA, 21 nt, Artificial Sequence
  Guide Sequence
acccccagcuuccccagcgcg

SEQ ID NO: 3233 - RNA, 21 nt, Artificial Sequence
  Guide Sequence
acuacccccagcuuccccagc

SEQ ID NO: 3234 - RNA, 21 nt, Artificial Sequence
  Guide Sequence
agcuuccccagcgcggcaccu

SEQ ID NO: 3235 - RNA, 21 nt, Artificial Sequence
  Guide Sequence
agguacaggugccgcgcuggg

SEQ ID NO: 3236 - RNA, 21 nt, Artificial Sequence
  Guide Sequence
aggugccgcgcuggggaagcu

SEQ ID NO: 3237 - RNA, 21 nt, Artificial Sequence
  Guide Sequence
cacacuacccccagcuucccc

SEQ ID NO: 3238 - RNA, 21 nt, Artificial Sequence
  Guide Sequence
cacuacccccagcuuccccag

SEQ ID NO: 3239 - RNA, 21 nt, Artificial Sequence
  Guide Sequence
cagcuuccccagcgcggcacc

SEQ ID NO: 3240 - RNA, 21 nt, Artificial Sequence
  Guide Sequence
caggugccgcgcuggggaagc

SEQ ID NO: 3241 - RNA, 21 nt, Artificial Sequence
  Guide Sequence
ccagcuuccccagcgcggcac

SEQ ID NO: 3242 - RNA, 21 nt, Artificial Sequence
  Guide Sequence
cccagcgcggcaccuguaccu

SEQ ID NO: 3243 - RNA, 21 nt, Artificial Sequence
  Guide Sequence
cccagcuuccccagcgcggca

SEQ ID NO: 3244 - RNA, 21 nt, Artificial Sequence
  Guide Sequence
ccccagcgcggcaccuguacc

SEQ ID NO: 3245 - RNA, 21 nt, Artificial Sequence
  Guide Sequence
cccggagguacaggugccgcg

SEQ ID NO: 3246 - RNA, 21 nt, Artificial Sequence
  Guide Sequence
ccggagguacaggugccgcgc

SEQ ID NO: 3247 - RNA, 21 nt, Artificial Sequence
  Guide Sequence
cgcgcuggggaagcugggggu

SEQ ID NO: 3248 - RNA, 21 nt, Artificial Sequence
  Guide Sequence
cgcuggggaagcuggggguag

SEQ ID NO: 3249 - RNA, 21 nt, Artificial Sequence
  Guide Sequence
cggagguacaggugccgcgcu

SEQ ID NO: 3250 - RNA, 21 nt, Artificial Sequence
  Guide Sequence
cuacccccagcuuccccagcg

SEQ ID NO: 3251 - RNA, 21 nt, Artificial Sequence
  Guide Sequence
cucacacuacccccagcuucc

SEQ ID NO: 3252 - RNA, 21 nt, Artificial Sequence
  Guide Sequence
cucucacacuacccccagcuu

SEQ ID NO: 3253 - RNA, 21 nt, Artificial Sequence
  Guide Sequence
cuggggaagcuggggguagug

SEQ ID NO: 3254 - RNA, 21 nt, Artificial Sequence
  Guide Sequence
cuuccccagcgcggcaccugu

SEQ ID NO: 3255 - RNA, 21 nt, Artificial Sequence
  Guide Sequence
gagguacaggugccgcgcugg

SEQ ID NO: 3256 - RNA, 21 nt, Artificial Sequence
  Guide Sequence
gcgcuggggaagcugggggua

SEQ ID NO: 3257 - RNA, 21 nt, Artificial Sequence
  Guide Sequence
gcuggggaagcuggggguagu

SEQ ID NO: 3258 - RNA, 21 nt, Artificial Sequence
  Guide Sequence
gcuuccccagcgcggcaccug

SEQ ID NO: 3259 - RNA, 21 nt, Artificial Sequence
  Guide Sequence
ggggaagcuggggguagugug

SEQ ID NO: 3260 - RNA, 21 nt, Artificial Sequence
  Guide Sequence
gguacaggugccgcgcugggg

SEQ ID NO: 3261 - RNA, 21 nt, Artificial Sequence
  Guide Sequence
ggugccgcgcuggggaagcug

SEQ ID NO: 3262 - RNA, 21 nt, Artificial Sequence
  Guide Sequence
guacaggugccgcgcugggga

SEQ ID NO: 3263 - RNA, 21 nt, Artificial Sequence
  Guide Sequence
gugccgcgcuggggaagcugg

SEQ ID NO: 3264 - RNA, 21 nt, Artificial Sequence
  Guide Sequence
uacaggugccgcgcuggggaa

SEQ ID NO: 3265 - RNA, 21 nt, Artificial Sequence
  Guide Sequence
uacccccagcuuccccagcgc

SEQ ID NO: 3266 - RNA, 21 nt, Artificial Sequence
  Guide Sequence
ucacacuacccccagcuuccc

SEQ ID NO: 3267 - RNA, 21 nt, Artificial Sequence
  Guide Sequence
uccccagcgcggcaccuguac

SEQ ID NO: 3268 - RNA, 21 nt, Artificial Sequence
  Guide Sequence
ucucacacuacccccagcuuc

SEQ ID NO: 3269 - RNA, 21 nt, Artificial Sequence
  Guide Sequence
ugccgcgcuggggaagcuggg

SEQ ID NO: 3270 - RNA, 21 nt, Artificial Sequence
  Guide Sequence
uggggaagcuggggguagugu

SEQ ID NO: 3271 - RNA, 21 nt, Artificial Sequence
  Guide Sequence
uuccccagcgcggcaccugua

SEQ ID NO: 3272 - RNA, 22 nt, Artificial Sequence
  Guide Sequence
acacuacccccagcuuccccag

SEQ ID NO: 3273 - RNA, 22 nt, Artificial Sequence
  Guide Sequence
acaggugccgcgcuggggaagc

SEQ ID NO: 3274 - RNA, 22 nt, Artificial Sequence
  Guide Sequence
acccccagcuuccccagcgcgg

SEQ ID NO: 3275 - RNA, 22 nt, Artificial Sequence
  Guide Sequence
acuacccccagcuuccccagcg

SEQ ID NO: 3276 - RNA, 22 nt, Artificial Sequence
  Guide Sequence
agcuuccccagcgcggcaccug

SEQ ID NO: 3277 - RNA, 22 nt, Artificial Sequence
  Guide Sequence
agguacaggugccgcgcugggg

SEQ ID NO: 3278 - RNA, 22 nt, Artificial Sequence
  Guide Sequence
aggugccgcgcuggggaagcug

SEQ ID NO: 3279 - RNA, 22 nt, Artificial Sequence
  Guide Sequence
cacacuacccccagcuucccca

SEQ ID NO: 3280 - RNA, 22 nt, Artificial Sequence
  Guide Sequence
cacuacccccagcuuccccagc

SEQ ID NO: 3281 - RNA, 22 nt, Artificial Sequence
  Guide Sequence
cagcuuccccagcgcggcaccu

SEQ ID NO: 3282 - RNA, 22 nt, Artificial Sequence
  Guide Sequence
caggugccgcgcuggggaagcu

SEQ ID NO: 3283 - RNA, 22 nt, Artificial Sequence
  Guide Sequence
ccagcuuccccagcgcggcacc

SEQ ID NO: 3284 - RNA, 22 nt, Artificial Sequence
  Guide Sequence
cccagcgcggcaccuguaccuc

SEQ ID NO: 3285 - RNA, 22 nt, Artificial Sequence
  Guide Sequence
cccagcuuccccagcgcggcac

SEQ ID NO: 3286 - RNA, 22 nt, Artificial Sequence
  Guide Sequence
ccccagcgcggcaccuguaccu

SEQ ID NO: 3287 - RNA, 22 nt, Artificial Sequence
  Guide Sequence
ccccagcuuccccagcgcggca

SEQ ID NO: 3288 - RNA, 22 nt, Artificial Sequence
  Guide Sequence
ccccggagguacaggugccgcg

SEQ ID NO: 3289 - RNA, 22 nt, Artificial Sequence
  Guide Sequence
cccggagguacaggugccgcgc

SEQ ID NO: 3290 - RNA, 22 nt, Artificial Sequence
  Guide Sequence
ccgcgcuggggaagcugggggu

SEQ ID NO: 3291 - RNA, 22 nt, Artificial Sequence
  Guide Sequence
ccggagguacaggugccgcgcu

SEQ ID NO: 3292 - RNA, 22 nt, Artificial Sequence
  Guide Sequence
ccucucacacuacccccagcuu

SEQ ID NO: 3293 - RNA, 22 nt, Artificial Sequence
  Guide Sequence
cgcgcuggggaagcugggggua

SEQ ID NO: 3294 - RNA, 22 nt, Artificial Sequence
  Guide Sequence
cgcuggggaagcuggggguagu

SEQ ID NO: 3295 - RNA, 22 nt, Artificial Sequence
  Guide Sequence
cuacccccagcuuccccagcgc

SEQ ID NO: 3296 - RNA, 22 nt, Artificial Sequence
  Guide Sequence
cucacacuacccccagcuuccc

SEQ ID NO: 3297 - RNA, 22 nt, Artificial Sequence
  Guide Sequence
cucucacacuacccccagcuuc

SEQ ID NO: 3298 - RNA, 22 nt, Artificial Sequence
  Guide Sequence
cuggggaagcuggggguagugu

SEQ ID NO: 3299 - RNA, 22 nt, Artificial Sequence
  Guide Sequence
cuuccccagcgcggcaccugua

SEQ ID NO: 3300 - RNA, 22 nt, Artificial Sequence
  Guide Sequence
gagguacaggugccgcgcuggg

SEQ ID NO: 3301 - RNA, 22 nt, Artificial Sequence
  Guide Sequence
gcgcuggggaagcuggggguag

SEQ ID NO: 3302 - RNA, 22 nt, Artificial Sequence
  Guide Sequence
gcuggggaagcuggggguagug

SEQ ID NO: 3303 - RNA, 22 nt, Artificial Sequence
  Guide Sequence
gcuuccccagcgcggcaccugu

SEQ ID NO: 3304 - RNA, 22 nt, Artificial Sequence
  Guide Sequence
ggagguacaggugccgcgcugg

SEQ ID NO: 3305 - RNA, 22 nt, Artificial Sequence
  Guide Sequence
ggggaagcuggggguaguguga

SEQ ID NO: 3306 - RNA, 22 nt, Artificial Sequence
  Guide Sequence
gguacaggugccgcgcugggga

SEQ ID NO: 3307 - RNA, 22 nt, Artificial Sequence
  Guide Sequence
ggugccgcgcuggggaagcugg

SEQ ID NO: 3308 - RNA, 22 nt, Artificial Sequence
  Guide Sequence
guacaggugccgcgcuggggaa

SEQ ID NO: 3309 - RNA, 22 nt, Artificial Sequence
  Guide Sequence
gugccgcgcuggggaagcuggg

SEQ ID NO: 3310 - RNA, 22 nt, Artificial Sequence
  Guide Sequence
uacaggugccgcgcuggggaag

SEQ ID NO: 3311 - RNA, 22 nt, Artificial Sequence
  Guide Sequence
uacccccagcuuccccagcgcg

SEQ ID NO: 3312 - RNA, 22 nt, Artificial Sequence
  Guide Sequence
ucacacuacccccagcuucccc

SEQ ID NO: 3313 - RNA, 22 nt, Artificial Sequence
  Guide Sequence
uccccagcgcggcaccuguacc

SEQ ID NO: 3314 - RNA, 22 nt, Artificial Sequence
  Guide Sequence
ucucacacuacccccagcuucc

SEQ ID NO: 3315 - RNA, 22 nt, Artificial Sequence
  Guide Sequence
ugccgcgcuggggaagcugggg

SEQ ID NO: 3316 - RNA, 22 nt, Artificial Sequence
  Guide Sequence
uggggaagcuggggguagugug

SEQ ID NO: 3317 - RNA, 22 nt, Artificial Sequence
  Guide Sequence
uuccccagcgcggcaccuguac

SEQ ID NO: 3318 - RNA, 20 nt, Artificial Sequence
  Guide Sequence
acagcguggcaccuguaccu

SEQ ID NO: 3319 - RNA, 20 nt, Artificial Sequence
  Guide Sequence
acaggugccacgcuguggaa

SEQ ID NO: 3320 - RNA, 20 nt, Artificial Sequence
  Guide Sequence
acccccagcuuccacagcgu

SEQ ID NO: 3321 - RNA, 20 nt, Artificial Sequence
  Guide Sequence
accccggagguacaggugcc

SEQ ID NO: 3322 - RNA, 20 nt, Artificial Sequence
  Guide Sequence
acuacccccagcuuccacag

SEQ ID NO: 3323 - RNA, 20 nt, Artificial Sequence
  Guide Sequence
agcguggcaccuguaccucc

SEQ ID NO: 3324 - RNA, 20 nt, Artificial Sequence
  Guide Sequence
agcuuccacagcguggcacc

SEQ ID NO: 3325 - RNA, 20 nt, Artificial Sequence
  Guide Sequence
agguacaggugccacgcugu

SEQ ID NO: 3326 - RNA, 20 nt, Artificial Sequence
  Guide Sequence
aggugccacgcuguggaagc

SEQ ID NO: 3327 - RNA, 20 nt, Artificial Sequence
  Guide Sequence
cacagcguggcaccuguacc

SEQ ID NO: 3328 - RNA, 20 nt, Artificial Sequence
  Guide Sequence
caccccggagguacaggugc

SEQ ID NO: 3329 - RNA, 20 nt, Artificial Sequence
  Guide Sequence
cacgcuguggaagcuggggg

SEQ ID NO: 3330 - RNA, 20 nt, Artificial Sequence
  Guide Sequence
cacuacccccagcuuccaca

SEQ ID NO: 3331 - RNA, 20 nt, Artificial Sequence
  Guide Sequence
cagcguggcaccuguaccuc

SEQ ID NO: 3332 - RNA, 20 nt, Artificial Sequence
  Guide Sequence
cagcuuccacagcguggcac

SEQ ID NO: 3333 - RNA, 20 nt, Artificial Sequence
  Guide Sequence
caggugccacgcuguggaag

SEQ ID NO: 3334 - RNA, 20 nt, Artificial Sequence
  Guide Sequence
ccacagcguggcaccuguac

SEQ ID NO: 3335 - RNA, 20 nt, Artificial Sequence
  Guide Sequence
ccaccccggagguacaggug

SEQ ID NO: 3336 - RNA, 20 nt, Artificial Sequence
  Guide Sequence
ccacgcuguggaagcugggg

SEQ ID NO: 3337 - RNA, 20 nt, Artificial Sequence
  Guide Sequence
ccagcuuccacagcguggca

SEQ ID NO: 3338 - RNA, 20 nt, Artificial Sequence
  Guide Sequence
cccagcuuccacagcguggc

SEQ ID NO: 3339 - RNA, 20 nt, Artificial Sequence
  Guide Sequence
ccccagcuuccacagcgugg

SEQ ID NO: 3340 - RNA, 20 nt, Artificial Sequence
  Guide Sequence
cccccagcuuccacagcgug

SEQ ID NO: 3341 - RNA, 20 nt, Artificial Sequence
  Guide Sequence
ccccggagguacaggugcca

SEQ ID NO: 3342 - RNA, 20 nt, Artificial Sequence
  Guide Sequence
cccggagguacaggugccac

SEQ ID NO: 3343 - RNA, 20 nt, Artificial Sequence
  Guide Sequence
ccggagguacaggugccacg

SEQ ID NO: 3344 - RNA, 20 nt, Artificial Sequence
  Guide Sequence
cggagguacaggugccacgc

SEQ ID NO: 3345 - RNA, 20 nt, Artificial Sequence
  Guide Sequence
cguggcaccuguaccuccgg

SEQ ID NO: 3346 - RNA, 20 nt, Artificial Sequence
  Guide Sequence
cuacccccagcuuccacagc

SEQ ID NO: 3347 - RNA, 20 nt, Artificial Sequence
  Guide Sequence
cuuccacagcguggcaccug

SEQ ID NO: 3348 - RNA, 20 nt, Artificial Sequence
  Guide Sequence
gagguacaggugccacgcug

SEQ ID NO: 3349 - RNA, 20 nt, Artificial Sequence
  Guide Sequence
gccaccccggagguacaggu

SEQ ID NO: 3350 - RNA, 20 nt, Artificial Sequence
  Guide Sequence
gccacgcuguggaagcuggg

SEQ ID NO: 3351 - RNA, 20 nt, Artificial Sequence
  Guide Sequence
gcguggcaccuguaccuccg

SEQ ID NO: 3352 - RNA, 20 nt, Artificial Sequence
  Guide Sequence
gcuuccacagcguggcaccu

SEQ ID NO: 3353 - RNA, 20 nt, Artificial Sequence
  Guide Sequence
ggagguacaggugccacgcu

SEQ ID NO: 3354 - RNA, 20 nt, Artificial Sequence
  Guide Sequence
gguacaggugccacgcugug

SEQ ID NO: 3355 - RNA, 20 nt, Artificial Sequence
  Guide Sequence
ggugccacgcuguggaagcu

SEQ ID NO: 3356 - RNA, 20 nt, Artificial Sequence
  Guide Sequence
guacaggugccacgcugugg

SEQ ID NO: 3357 - RNA, 20 nt, Artificial Sequence
  Guide Sequence
gugccacgcuguggaagcug

SEQ ID NO: 3358 - RNA, 20 nt, Artificial Sequence
  Guide Sequence
guggcaccuguaccuccggg

SEQ ID NO: 3359 - RNA, 20 nt, Artificial Sequence
  Guide Sequence
uacaggugccacgcugugga

SEQ ID NO: 3360 - RNA, 20 nt, Artificial Sequence
  Guide Sequence
uacccccagcuuccacagcg

SEQ ID NO: 3361 - RNA, 20 nt, Artificial Sequence
  Guide Sequence
uccacagcguggcaccugua

SEQ ID NO: 3362 - RNA, 20 nt, Artificial Sequence
  Guide Sequence
ugccacgcuguggaagcugg

SEQ ID NO: 3363 - RNA, 20 nt, Artificial Sequence
  Guide Sequence
uuccacagcguggcaccugu

SEQ ID NO: 3364 - RNA, 21 nt, Artificial Sequence
  Guide Sequence
acacuacccccagcuuccaca

SEQ ID NO: 3365 - RNA, 21 nt, Artificial Sequence
  Guide Sequence
acagcguggcaccuguaccuc

SEQ ID NO: 3366 - RNA, 21 nt, Artificial Sequence
  Guide Sequence
acaggugccacgcuguggaag

SEQ ID NO: 3367 - RNA, 21 nt, Artificial Sequence
  Guide Sequence
acccccagcuuccacagcgug

SEQ ID NO: 3368 - RNA, 21 nt, Artificial Sequence
  Guide Sequence
accccggagguacaggugcca

SEQ ID NO: 3369 - RNA, 21 nt, Artificial Sequence
  Guide Sequence
acuacccccagcuuccacagc

SEQ ID NO: 3370 - RNA, 21 nt, Artificial Sequence
  Guide Sequence
agcguggcaccuguaccuccg

SEQ ID NO: 3371 - RNA, 21 nt, Artificial Sequence
  Guide Sequence
agcuuccacagcguggcaccu

SEQ ID NO: 3372 - RNA, 21 nt, Artificial Sequence
  Guide Sequence
agguacaggugccacgcugug

SEQ ID NO: 3373 - RNA, 21 nt, Artificial Sequence
  Guide Sequence
aggugccacgcuguggaagcu

SEQ ID NO: 3374 - RNA, 21 nt, Artificial Sequence
  Guide Sequence
cacagcguggcaccuguaccu

SEQ ID NO: 3375 - RNA, 21 nt, Artificial Sequence
  Guide Sequence
caccccggagguacaggugcc

SEQ ID NO: 3376 - RNA, 21 nt, Artificial Sequence
  Guide Sequence
cacgcuguggaagcugggggu

SEQ ID NO: 3377 - RNA, 21 nt, Artificial Sequence
  Guide Sequence
cacuacccccagcuuccacag

SEQ ID NO: 3378 - RNA, 21 nt, Artificial Sequence
  Guide Sequence
cagcguggcaccuguaccucc

SEQ ID NO: 3379 - RNA, 21 nt, Artificial Sequence
  Guide Sequence
cagcuuccacagcguggcacc

SEQ ID NO: 3380 - RNA, 21 nt, Artificial Sequence
  Guide Sequence
caggugccacgcuguggaagc

SEQ ID NO: 3381 - RNA, 21 nt, Artificial Sequence
  Guide Sequence
ccacagcguggcaccuguacc

SEQ ID NO: 3382 - RNA, 21 nt, Artificial Sequence
  Guide Sequence
ccaccccggagguacaggugc

SEQ ID NO: 3383 - RNA, 21 nt, Artificial Sequence
  Guide Sequence
ccacgcuguggaagcuggggg

SEQ ID NO: 3384 - RNA, 21 nt, Artificial Sequence
  Guide Sequence
ccagcuuccacagcguggcac

SEQ ID NO: 3385 - RNA, 21 nt, Artificial Sequence
  Guide Sequence
cccagcuuccacagcguggca

SEQ ID NO: 3386 - RNA, 21 nt, Artificial Sequence
  Guide Sequence
ccccagcuuccacagcguggc

SEQ ID NO: 3387 - RNA, 21 nt, Artificial Sequence
  Guide Sequence
cccccagcuuccacagcgugg

SEQ ID NO: 3388 - RNA, 21 nt, Artificial Sequence
  Guide Sequence
ccccggagguacaggugccac

SEQ ID NO: 3389 - RNA, 21 nt, Artificial Sequence
  Guide Sequence
cccggagguacaggugccacg

SEQ ID NO: 3390 - RNA, 21 nt, Artificial Sequence
  Guide Sequence
ccggagguacaggugccacgc

SEQ ID NO: 3391 - RNA, 21 nt, Artificial Sequence
  Guide Sequence
cgccaccccggagguacaggu

SEQ ID NO: 3392 - RNA, 21 nt, Artificial Sequence
  Guide Sequence
cggagguacaggugccacgcu

SEQ ID NO: 3393 - RNA, 21 nt, Artificial Sequence
  Guide Sequence
cguggcaccuguaccuccggg

SEQ ID NO: 3394 - RNA, 21 nt, Artificial Sequence
  Guide Sequence
cuacccccagcuuccacagcg

SEQ ID NO: 3395 - RNA, 21 nt, Artificial Sequence
  Guide Sequence
cuuccacagcguggcaccugu

SEQ ID NO: 3396 - RNA, 21 nt, Artificial Sequence
  Guide Sequence
gagguacaggugccacgcugu

SEQ ID NO: 3397 - RNA, 21 nt, Artificial Sequence
  Guide Sequence
gccaccccggagguacaggug

SEQ ID NO: 3398 - RNA, 21 nt, Artificial Sequence
  Guide Sequence
gccacgcuguggaagcugggg

SEQ ID NO: 3399 - RNA, 21 nt, Artificial Sequence
  Guide Sequence
gcguggcaccuguaccuccgg

SEQ ID NO: 3400 - RNA, 21 nt, Artificial Sequence
  Guide Sequence
gcuuccacagcguggcaccug

SEQ ID NO: 3401 - RNA, 21 nt, Artificial Sequence
  Guide Sequence
ggagguacaggugccacgcug

SEQ ID NO: 3402 - RNA, 21 nt, Artificial Sequence
  Guide Sequence
gguacaggugccacgcugugg

SEQ ID NO: 3403 - RNA, 21 nt, Artificial Sequence
  Guide Sequence
ggugccacgcuguggaagcug

SEQ ID NO: 3404 - RNA, 21 nt, Artificial Sequence
  Guide Sequence
guacaggugccacgcugugga

SEQ ID NO: 3405 - RNA, 21 nt, Artificial Sequence
  Guide Sequence
gugccacgcuguggaagcugg

SEQ ID NO: 3406 - RNA, 21 nt, Artificial Sequence
  Guide Sequence
guggcaccuguaccuccgggg

SEQ ID NO: 3407 - RNA, 21 nt, Artificial Sequence
  Guide Sequence
uacaggugccacgcuguggaa

SEQ ID NO: 3408 - RNA, 21 nt, Artificial Sequence
  Guide Sequence
uacccccagcuuccacagcgu

SEQ ID NO: 3409 - RNA, 21 nt, Artificial Sequence
  Guide Sequence
uccacagcguggcaccuguac

SEQ ID NO: 3410 - RNA, 21 nt, Artificial Sequence
  Guide Sequence
ugccacgcuguggaagcuggg

SEQ ID NO: 3411 - RNA, 21 nt, Artificial Sequence
  Guide Sequence
uuccacagcguggcaccugua

SEQ ID NO: 3412 - RNA, 22 nt, Artificial Sequence
  Guide Sequence
acacuacccccagcuuccacag

SEQ ID NO: 3413 - RNA, 22 nt, Artificial Sequence
  Guide Sequence
acagcguggcaccuguaccucc

SEQ ID NO: 3414 - RNA, 22 nt, Artificial Sequence
  Guide Sequence
acaggugccacgcuguggaagc

SEQ ID NO: 3415 - RNA, 22 nt, Artificial Sequence
  Guide Sequence
acccccagcuuccacagcgugg

SEQ ID NO: 3416 - RNA, 22 nt, Artificial Sequence
  Guide Sequence
accccggagguacaggugccac

SEQ ID NO: 3417 - RNA, 22 nt, Artificial Sequence
  Guide Sequence
acuacccccagcuuccacagcg

SEQ ID NO: 3418 - RNA, 22 nt, Artificial Sequence
  Guide Sequence
agcguggcaccuguaccuccgg

SEQ ID NO: 3419 - RNA, 22 nt, Artificial Sequence
  Guide Sequence
agcuuccacagcguggcaccug

SEQ ID NO: 3420 - RNA, 22 nt, Artificial Sequence
  Guide Sequence
agguacaggugccacgcugugg

SEQ ID NO: 3421 - RNA, 22 nt, Artificial Sequence
  Guide Sequence
aggugccacgcuguggaagcug

SEQ ID NO: 3422 - RNA, 22 nt, Artificial Sequence
  Guide Sequence
cacacuacccccagcuuccaca

SEQ ID NO: 3423 - RNA, 22 nt, Artificial Sequence
  Guide Sequence
cacagcguggcaccuguaccuc

SEQ ID NO: 3424 - RNA, 22 nt, Artificial Sequence
  Guide Sequence
caccccggagguacaggugcca

SEQ ID NO: 3425 - RNA, 22 nt, Artificial Sequence
  Guide Sequence
cacgcuguggaagcugggggua

SEQ ID NO: 3426 - RNA, 22 nt, Artificial Sequence
  Guide Sequence
cacuacccccagcuuccacagc

SEQ ID NO: 3427 - RNA, 22 nt, Artificial Sequence
  Guide Sequence
cagcguggcaccuguaccuccg

SEQ ID NO: 3428 - RNA, 22 nt, Artificial Sequence
  Guide Sequence
cagcuuccacagcguggcaccu

SEQ ID NO: 3429 - RNA, 22 nt, Artificial Sequence
  Guide Sequence
caggugccacgcuguggaagcu

SEQ ID NO: 3430 - RNA, 22 nt, Artificial Sequence
  Guide Sequence
ccacagcguggcaccuguaccu

SEQ ID NO: 3431 - RNA, 22 nt, Artificial Sequence
  Guide Sequence
ccaccccggagguacaggugcc

SEQ ID NO: 3432 - RNA, 22 nt, Artificial Sequence
  Guide Sequence
ccacgcuguggaagcugggggu

SEQ ID NO: 3433 - RNA, 22 nt, Artificial Sequence
  Guide Sequence
ccagcuuccacagcguggcacc

SEQ ID NO: 3434 - RNA, 22 nt, Artificial Sequence
  Guide Sequence
cccagcuuccacagcguggcac

SEQ ID NO: 3435 - RNA, 22 nt, Artificial Sequence
  Guide Sequence
ccccagcuuccacagcguggca

SEQ ID NO: 3436 - RNA, 22 nt, Artificial Sequence
  Guide Sequence
cccccagcuuccacagcguggc

SEQ ID NO: 3437 - RNA, 22 nt, Artificial Sequence
  Guide Sequence
ccccggagguacaggugccacg

SEQ ID NO: 3438 - RNA, 22 nt, Artificial Sequence
  Guide Sequence
cccggagguacaggugccacgc

SEQ ID NO: 3439 - RNA, 22 nt, Artificial Sequence
  Guide Sequence
ccggagguacaggugccacgcu

SEQ ID NO: 3440 - RNA, 22 nt, Artificial Sequence
  Guide Sequence
cgccaccccggagguacaggug

SEQ ID NO: 3441 - RNA, 22 nt, Artificial Sequence
  Guide Sequence
cggagguacaggugccacgcug

SEQ ID NO: 3442 - RNA, 22 nt, Artificial Sequence
  Guide Sequence
cguggcaccuguaccuccgggg

SEQ ID NO: 3443 - RNA, 22 nt, Artificial Sequence
  Guide Sequence
cuacccccagcuuccacagcgu

SEQ ID NO: 3444 - RNA, 22 nt, Artificial Sequence
  Guide Sequence
cuuccacagcguggcaccugua

SEQ ID NO: 3445 - RNA, 22 nt, Artificial Sequence
  Guide Sequence
gagguacaggugccacgcugug

SEQ ID NO: 3446 - RNA, 22 nt, Artificial Sequence
  Guide Sequence
gccaccccggagguacaggugc

SEQ ID NO: 3447 - RNA, 22 nt, Artificial Sequence
  Guide Sequence
gccacgcuguggaagcuggggg

SEQ ID NO: 3448 - RNA, 22 nt, Artificial Sequence
  Guide Sequence
gcgccaccccggagguacaggu

SEQ ID NO: 3449 - RNA, 22 nt, Artificial Sequence
  Guide Sequence
gcguggcaccuguaccuccggg

SEQ ID NO: 3450 - RNA, 22 nt, Artificial Sequence
  Guide Sequence
gcuuccacagcguggcaccugu

SEQ ID NO: 3451 - RNA, 22 nt, Artificial Sequence
  Guide Sequence
ggagguacaggugccacgcugu

SEQ ID NO: 3452 - RNA, 22 nt, Artificial Sequence
  Guide Sequence
gguacaggugccacgcugugga

SEQ ID NO: 3453 - RNA, 22 nt, Artificial Sequence
  Guide Sequence
ggugccacgcuguggaagcugg

SEQ ID NO: 3454 - RNA, 22 nt, Artificial Sequence
  Guide Sequence
guacaggugccacgcuguggaa

SEQ ID NO: 3455 - RNA, 22 nt, Artificial Sequence
  Guide Sequence
gugccacgcuguggaagcuggg

SEQ ID NO: 3456 - RNA, 22 nt, Artificial Sequence
  Guide Sequence
guggcaccuguaccuccggggu

SEQ ID NO: 3457 - RNA, 22 nt, Artificial Sequence
  Guide Sequence
uacaggugccacgcuguggaag

SEQ ID NO: 3458 - RNA, 22 nt, Artificial Sequence
  Guide Sequence
uacccccagcuuccacagcgug

SEQ ID NO: 3459 - RNA, 22 nt, Artificial Sequence
  Guide Sequence
uccacagcguggcaccuguacc

SEQ ID NO: 3460 - RNA, 22 nt, Artificial Sequence
  Guide Sequence
ugccacgcuguggaagcugggg

SEQ ID NO: 3461 - RNA, 22 nt, Artificial Sequence
  Guide Sequence
uuccacagcguggcaccuguac

SEQ ID NO: 3462 - RNA, 20 nt, Artificial Sequence
  Guide Sequence
acagcgcagcaccuguaccu

SEQ ID NO: 3463 - RNA, 20 nt, Artificial Sequence
  Guide Sequence
acaggugcugcgcuguggaa

SEQ ID NO: 3464 - RNA, 20 nt, Artificial Sequence
  Guide Sequence
acccccagcuuccacagcgc

SEQ ID NO: 3465 - RNA, 20 nt, Artificial Sequence
  Guide Sequence
accccggagguacaggugcu

SEQ ID NO: 3466 - RNA, 20 nt, Artificial Sequence
  Guide Sequence
agcgcagcaccuguaccucc

SEQ ID NO: 3467 - RNA, 20 nt, Artificial Sequence
  Guide Sequence
agcuuccacagcgcagcacc

SEQ ID NO: 3468 - RNA, 20 nt, Artificial Sequence
  Guide Sequence
agguacaggugcugcgcugu

SEQ ID NO: 3469 - RNA, 20 nt, Artificial Sequence
  Guide Sequence
aggugcugcgcuguggaagc

SEQ ID NO: 3470 - RNA, 20 nt, Artificial Sequence
  Guide Sequence
cacagcgcagcaccuguacc

SEQ ID NO: 3471 - RNA, 20 nt, Artificial Sequence
  Guide Sequence
cagcaccuguaccuccgggg

SEQ ID NO: 3472 - RNA, 20 nt, Artificial Sequence
  Guide Sequence
cagcgcagcaccuguaccuc

SEQ ID NO: 3473 - RNA, 20 nt, Artificial Sequence
  Guide Sequence
cagcuuccacagcgcagcac

SEQ ID NO: 3474 - RNA, 20 nt, Artificial Sequence
  Guide Sequence
caggugcugcgcuguggaag

SEQ ID NO: 3475 - RNA, 20 nt, Artificial Sequence
  Guide Sequence
ccacagcgcagcaccuguac

SEQ ID NO: 3476 - RNA, 20 nt, Artificial Sequence
  Guide Sequence
ccagcuuccacagcgcagca

SEQ ID NO: 3477 - RNA, 20 nt, Artificial Sequence
  Guide Sequence
cccagcuuccacagcgcagc

SEQ ID NO: 3478 - RNA, 20 nt, Artificial Sequence
  Guide Sequence
ccccagcuuccacagcgcag

SEQ ID NO: 3479 - RNA, 20 nt, Artificial Sequence
  Guide Sequence
cccccagcuuccacagcgca

SEQ ID NO: 3480 - RNA, 20 nt, Artificial Sequence
  Guide Sequence
ccccggagguacaggugcug

SEQ ID NO: 3481 - RNA, 20 nt, Artificial Sequence
  Guide Sequence
cccggagguacaggugcugc

SEQ ID NO: 3482 - RNA, 20 nt, Artificial Sequence
  Guide Sequence
ccggagguacaggugcugcg

SEQ ID NO: 3483 - RNA, 20 nt, Artificial Sequence
  Guide Sequence
cgcagcaccuguaccuccgg

SEQ ID NO: 3484 - RNA, 20 nt, Artificial Sequence
  Guide Sequence
cgccaccccggagguacagg

SEQ ID NO: 3485 - RNA, 20 nt, Artificial Sequence
  Guide Sequence
cggagguacaggugcugcgc

SEQ ID NO: 3486 - RNA, 20 nt, Artificial Sequence
  Guide Sequence
cugcgcuguggaagcugggg

SEQ ID NO: 3487 - RNA, 20 nt, Artificial Sequence
  Guide Sequence
cuuccacagcgcagcaccug

SEQ ID NO: 3488 - RNA, 20 nt, Artificial Sequence
  Guide Sequence
gagguacaggugcugcgcug

SEQ ID NO: 3489 - RNA, 20 nt, Artificial Sequence
  Guide Sequence
gcagcaccuguaccuccggg

SEQ ID NO: 3490 - RNA, 20 nt, Artificial Sequence
  Guide Sequence
gcgcagcaccuguaccuccg

SEQ ID NO: 3491 - RNA, 20 nt, Artificial Sequence
  Guide Sequence
gcugcgcuguggaagcuggg

SEQ ID NO: 3492 - RNA, 20 nt, Artificial Sequence
  Guide Sequence
gcuuccacagcgcagcaccu

SEQ ID NO: 3493 - RNA, 20 nt, Artificial Sequence
  Guide Sequence
ggagguacaggugcugcgcu

SEQ ID NO: 3494 - RNA, 20 nt, Artificial Sequence
  Guide Sequence
gguacaggugcugcgcugug

SEQ ID NO: 3495 - RNA, 20 nt, Artificial Sequence
  Guide Sequence
ggugcugcgcuguggaagcu

SEQ ID NO: 3496 - RNA, 20 nt, Artificial Sequence
  Guide Sequence
guacaggugcugcgcugugg

SEQ ID NO: 3497 - RNA, 20 nt, Artificial Sequence
  Guide Sequence
gugcugcgcuguggaagcug

SEQ ID NO: 3498 - RNA, 20 nt, Artificial Sequence
  Guide Sequence
uacaggugcugcgcugugga

SEQ ID NO: 3499 - RNA, 20 nt, Artificial Sequence
  Guide Sequence
uccacagcgcagcaccugua

SEQ ID NO: 3500 - RNA, 20 nt, Artificial Sequence
  Guide Sequence
ugcugcgcuguggaagcugg

SEQ ID NO: 3501 - RNA, 20 nt, Artificial Sequence
  Guide Sequence
uuccacagcgcagcaccugu

SEQ ID NO: 3502 - RNA, 21 nt, Artificial Sequence
  Guide Sequence
acagcgcagcaccuguaccuc

SEQ ID NO: 3503 - RNA, 21 nt, Artificial Sequence
  Guide Sequence
acaggugcugcgcuguggaag

SEQ ID NO: 3504 - RNA, 21 nt, Artificial Sequence
  Guide Sequence
acccccagcuuccacagcgca

SEQ ID NO: 3505 - RNA, 21 nt, Artificial Sequence
  Guide Sequence
accccggagguacaggugcug

SEQ ID NO: 3506 - RNA, 21 nt, Artificial Sequence
  Guide Sequence
agcgcagcaccuguaccuccg

SEQ ID NO: 3507 - RNA, 21 nt, Artificial Sequence
  Guide Sequence
agcuuccacagcgcagcaccu

SEQ ID NO: 3508 - RNA, 21 nt, Artificial Sequence
  Guide Sequence
agguacaggugcugcgcugug

SEQ ID NO: 3509 - RNA, 21 nt, Artificial Sequence
  Guide Sequence
aggugcugcgcuguggaagcu

SEQ ID NO: 3510 - RNA, 21 nt, Artificial Sequence
  Guide Sequence
cacagcgcagcaccuguaccu

SEQ ID NO: 3511 - RNA, 21 nt, Artificial Sequence
  Guide Sequence
caccccggagguacaggugcu

SEQ ID NO: 3512 - RNA, 21 nt, Artificial Sequence
  Guide Sequence
cagcaccuguaccuccggggu

SEQ ID NO: 3513 - RNA, 21 nt, Artificial Sequence
  Guide Sequence
cagcgcagcaccuguaccucc

SEQ ID NO: 3514 - RNA, 21 nt, Artificial Sequence
  Guide Sequence
cagcuuccacagcgcagcacc

SEQ ID NO: 3515 - RNA, 21 nt, Artificial Sequence
  Guide Sequence
caggugcugcgcuguggaagc

SEQ ID NO: 3516 - RNA, 21 nt, Artificial Sequence
  Guide Sequence
ccacagcgcagcaccuguacc

SEQ ID NO: 3517 - RNA, 21 nt, Artificial Sequence
  Guide Sequence
ccagcuuccacagcgcagcac

SEQ ID NO: 3518 - RNA, 21 nt, Artificial Sequence
  Guide Sequence
cccagcuuccacagcgcagca

SEQ ID NO: 3519 - RNA, 21 nt, Artificial Sequence
  Guide Sequence
ccccagcuuccacagcgcagc

SEQ ID NO: 3520 - RNA, 21 nt, Artificial Sequence
  Guide Sequence
cccccagcuuccacagcgcag

SEQ ID NO: 3521 - RNA, 21 nt, Artificial Sequence
  Guide Sequence
ccccggagguacaggugcugc

SEQ ID NO: 3522 - RNA, 21 nt, Artificial Sequence
  Guide Sequence
cccggagguacaggugcugcg

SEQ ID NO: 3523 - RNA, 21 nt, Artificial Sequence
  Guide Sequence
ccggagguacaggugcugcgc

SEQ ID NO: 3524 - RNA, 21 nt, Artificial Sequence
  Guide Sequence
cgcagcaccuguaccuccggg

SEQ ID NO: 3525 - RNA, 21 nt, Artificial Sequence
  Guide Sequence
cggagguacaggugcugcgcu

SEQ ID NO: 3526 - RNA, 21 nt, Artificial Sequence
  Guide Sequence
cugcgcuguggaagcuggggg

SEQ ID NO: 3527 - RNA, 21 nt, Artificial Sequence
  Guide Sequence
cuuccacagcgcagcaccugu

SEQ ID NO: 3528 - RNA, 21 nt, Artificial Sequence
  Guide Sequence
gagguacaggugcugcgcugu

SEQ ID NO: 3529 - RNA, 21 nt, Artificial Sequence
  Guide Sequence
gcagcaccuguaccuccgggg

SEQ ID NO: 3530 - RNA, 21 nt, Artificial Sequence
  Guide Sequence
gcgcagcaccuguaccuccgg

SEQ ID NO: 3531 - RNA, 21 nt, Artificial Sequence
  Guide Sequence
gcgccaccccggagguacagg

SEQ ID NO: 3532 - RNA, 21 nt, Artificial Sequence
  Guide Sequence
gcugcgcuguggaagcugggg

SEQ ID NO: 3533 - RNA, 21 nt, Artificial Sequence
  Guide Sequence
gcuuccacagcgcagcaccug

SEQ ID NO: 3534 - RNA, 21 nt, Artificial Sequence
  Guide Sequence
ggagguacaggugcugcgcug

SEQ ID NO: 3535 - RNA, 21 nt, Artificial Sequence
  Guide Sequence
gguacaggugcugcgcugugg

SEQ ID NO: 3536 - RNA, 21 nt, Artificial Sequence
  Guide Sequence
ggugcugcgcuguggaagcug

SEQ ID NO: 3537 - RNA, 21 nt, Artificial Sequence
  Guide Sequence
guacaggugcugcgcugugga

SEQ ID NO: 3538 - RNA, 21 nt, Artificial Sequence
  Guide Sequence
gugcugcgcuguggaagcugg

SEQ ID NO: 3539 - RNA, 21 nt, Artificial Sequence
  Guide Sequence
uacaggugcugcgcuguggaa

SEQ ID NO: 3540 - RNA, 21 nt, Artificial Sequence
  Guide Sequence
uacccccagcuuccacagcgc

SEQ ID NO: 3541 - RNA, 21 nt, Artificial Sequence
  Guide Sequence
uccacagcgcagcaccuguac

SEQ ID NO: 3542 - RNA, 21 nt, Artificial Sequence
  Guide Sequence
ugcugcgcuguggaagcuggg

SEQ ID NO: 3543 - RNA, 21 nt, Artificial Sequence
  Guide Sequence
uuccacagcgcagcaccugua

SEQ ID NO: 3544 - RNA, 22 nt, Artificial Sequence
  Guide Sequence
acagcgcagcaccuguaccucc

SEQ ID NO: 3545 - RNA, 22 nt, Artificial Sequence
  Guide Sequence
acaggugcugcgcuguggaagc

SEQ ID NO: 3546 - RNA, 22 nt, Artificial Sequence
  Guide Sequence
acccccagcuuccacagcgcag

SEQ ID NO: 3547 - RNA, 22 nt, Artificial Sequence
  Guide Sequence
accccggagguacaggugcugc

SEQ ID NO: 3548 - RNA, 22 nt, Artificial Sequence
  Guide Sequence
agcgcagcaccuguaccuccgg

SEQ ID NO: 3549 - RNA, 22 nt, Artificial Sequence
  Guide Sequence
agcgccaccccggagguacagg

SEQ ID NO: 3550 - RNA, 22 nt, Artificial Sequence
  Guide Sequence
agcuuccacagcgcagcaccug

SEQ ID NO: 3551 - RNA, 22 nt, Artificial Sequence
  Guide Sequence
agguacaggugcugcgcugugg

SEQ ID NO: 3552 - RNA, 22 nt, Artificial Sequence
  Guide Sequence
aggugcugcgcuguggaagcug

SEQ ID NO: 3553 - RNA, 22 nt, Artificial Sequence
  Guide Sequence
cacagcgcagcaccuguaccuc

SEQ ID NO: 3554 - RNA, 22 nt, Artificial Sequence
  Guide Sequence
caccccggagguacaggugcug

SEQ ID NO: 3555 - RNA, 22 nt, Artificial Sequence
  Guide Sequence
cagcaccuguaccuccggggug

SEQ ID NO: 3556 - RNA, 22 nt, Artificial Sequence
  Guide Sequence
cagcgcagcaccuguaccuccg

SEQ ID NO: 3557 - RNA, 22 nt, Artificial Sequence
  Guide Sequence
cagcuuccacagcgcagcaccu

SEQ ID NO: 3558 - RNA, 22 nt, Artificial Sequence
  Guide Sequence
caggugcugcgcuguggaagcu

SEQ ID NO: 3559 - RNA, 22 nt, Artificial Sequence
  Guide Sequence
ccacagcgcagcaccuguaccu

SEQ ID NO: 3560 - RNA, 22 nt, Artificial Sequence
  Guide Sequence
ccaccccggagguacaggugcu

SEQ ID NO: 3561 - RNA, 22 nt, Artificial Sequence
  Guide Sequence
ccagcuuccacagcgcagcacc

SEQ ID NO: 3562 - RNA, 22 nt, Artificial Sequence
  Guide Sequence
cccagcuuccacagcgcagcac

SEQ ID NO: 3563 - RNA, 22 nt, Artificial Sequence
  Guide Sequence
ccccagcuuccacagcgcagca

SEQ ID NO: 3564 - RNA, 22 nt, Artificial Sequence
  Guide Sequence
cccccagcuuccacagcgcagc

SEQ ID NO: 3565 - RNA, 22 nt, Artificial Sequence
  Guide Sequence
ccccggagguacaggugcugcg

SEQ ID NO: 3566 - RNA, 22 nt, Artificial Sequence
  Guide Sequence
cccggagguacaggugcugcgc

SEQ ID NO: 3567 - RNA, 22 nt, Artificial Sequence
  Guide Sequence
ccggagguacaggugcugcgcu

SEQ ID NO: 3568 - RNA, 22 nt, Artificial Sequence
  Guide Sequence
cgcagcaccuguaccuccgggg

SEQ ID NO: 3569 - RNA, 22 nt, Artificial Sequence
  Guide Sequence
cggagguacaggugcugcgcug

SEQ ID NO: 3570 - RNA, 22 nt, Artificial Sequence
  Guide Sequence
cuacccccagcuuccacagcgc

SEQ ID NO: 3571 - RNA, 22 nt, Artificial Sequence
  Guide Sequence
cugcgcuguggaagcugggggu

SEQ ID NO: 3572 - RNA, 22 nt, Artificial Sequence
  Guide Sequence
cuuccacagcgcagcaccugua

SEQ ID NO: 3573 - RNA, 22 nt, Artificial Sequence
  Guide Sequence
gagguacaggugcugcgcugug

SEQ ID NO: 3574 - RNA, 22 nt, Artificial Sequence
  Guide Sequence
gcagcaccuguaccuccggggu

SEQ ID NO: 3575 - RNA, 22 nt, Artificial Sequence
  Guide Sequence
gcgcagcaccuguaccuccggg

SEQ ID NO: 3576 - RNA, 22 nt, Artificial Sequence
  Guide Sequence
gcugcgcuguggaagcuggggg

SEQ ID NO: 3577 - RNA, 22 nt, Artificial Sequence
  Guide Sequence
gcuuccacagcgcagcaccugu

SEQ ID NO: 3578 - RNA, 22 nt, Artificial Sequence
  Guide Sequence
ggagguacaggugcugcgcugu

SEQ ID NO: 3579 - RNA, 22 nt, Artificial Sequence
  Guide Sequence
gguacaggugcugcgcugugga

SEQ ID NO: 3580 - RNA, 22 nt, Artificial Sequence
  Guide Sequence
ggugcugcgcuguggaagcugg

SEQ ID NO: 3581 - RNA, 22 nt, Artificial Sequence
  Guide Sequence
guacaggugcugcgcuguggaa

SEQ ID NO: 3582 - RNA, 22 nt, Artificial Sequence
  Guide Sequence
gugcugcgcuguggaagcuggg

SEQ ID NO: 3583 - RNA, 22 nt, Artificial Sequence
  Guide Sequence
uacaggugcugcgcuguggaag

SEQ ID NO: 3584 - RNA, 22 nt, Artificial Sequence
  Guide Sequence
uacccccagcuuccacagcgca

SEQ ID NO: 3585 - RNA, 22 nt, Artificial Sequence
  Guide Sequence
uccacagcgcagcaccuguacc

SEQ ID NO: 3586 - RNA, 22 nt, Artificial Sequence
  Guide Sequence
ugcugcgcuguggaagcugggg

SEQ ID NO: 3587 - RNA, 22 nt, Artificial Sequence
  Guide Sequence
uuccacagcgcagcaccuguac

SEQ ID NO: 3588 - RNA, 20 nt, Artificial Sequence
  Guide Sequence
aaccccagugccaccccgga

SEQ ID NO: 3589 - RNA, 20 nt, Artificial Sequence
  Guide Sequence
accccagugccaccccggag

SEQ ID NO: 3590 - RNA, 20 nt, Artificial Sequence
  Guide Sequence
accuccgggguggcacuggg

SEQ ID NO: 3591 - RNA, 20 nt, Artificial Sequence
  Guide Sequence
accuguaccuccgggguggc

SEQ ID NO: 3592 - RNA, 20 nt, Artificial Sequence
  Guide Sequence
agccaaccccagugccaccc

SEQ ID NO: 3593 - RNA, 20 nt, Artificial Sequence
  Guide Sequence
agugccaccccggagguaca

SEQ ID NO: 3594 - RNA, 20 nt, Artificial Sequence
  Guide Sequence
auggagccaaccccagugcc

SEQ ID NO: 3595 - RNA, 20 nt, Artificial Sequence
  Guide Sequence
caaccccagugccaccccgg

SEQ ID NO: 3596 - RNA, 20 nt, Artificial Sequence
  Guide Sequence
caccuguaccuccggggugg

SEQ ID NO: 3597 - RNA, 20 nt, Artificial Sequence
  Guide Sequence
cacugggguuggcuccauga

SEQ ID NO: 3598 - RNA, 20 nt, Artificial Sequence
  Guide Sequence
cagugccaccccggagguac

SEQ ID NO: 3599 - RNA, 20 nt, Artificial Sequence
  Guide Sequence
cauggagccaaccccagugc

SEQ ID NO: 3600 - RNA, 20 nt, Artificial Sequence
  Guide Sequence
ccaaccccagugccaccccg

SEQ ID NO: 3601 - RNA, 20 nt, Artificial Sequence
  Guide Sequence
ccagugccaccccggaggua

SEQ ID NO: 3602 - RNA, 20 nt, Artificial Sequence
  Guide Sequence
cccagugccaccccggaggu

SEQ ID NO: 3603 - RNA, 20 nt, Artificial Sequence
  Guide Sequence
ccccagugccaccccggagg

SEQ ID NO: 3604 - RNA, 20 nt, Artificial Sequence
  Guide Sequence
ccgggguggcacugggguug

SEQ ID NO: 3605 - RNA, 20 nt, Artificial Sequence
  Guide Sequence
ccuccgggguggcacugggg

SEQ ID NO: 3606 - RNA, 20 nt, Artificial Sequence
  Guide Sequence
ccuguaccuccgggguggca

SEQ ID NO: 3607 - RNA, 20 nt, Artificial Sequence
  Guide Sequence
cgggguggcacugggguugg

SEQ ID NO: 3608 - RNA, 20 nt, Artificial Sequence
  Guide Sequence
cuccgggguggcacuggggu

SEQ ID NO: 3609 - RNA, 20 nt, Artificial Sequence
  Guide Sequence
cuguaccuccgggguggcac

SEQ ID NO: 3610 - RNA, 20 nt, Artificial Sequence
  Guide Sequence
cuuggucauggagccaaccc

SEQ ID NO: 3611 - RNA, 20 nt, Artificial Sequence
  Guide Sequence
gagccaaccccagugccacc

SEQ ID NO: 3612 - RNA, 20 nt, Artificial Sequence
  Guide Sequence
gcaccuguaccuccggggug

SEQ ID NO: 3613 - RNA, 20 nt, Artificial Sequence
  Guide Sequence
gcacugggguuggcuccaug

SEQ ID NO: 3614 - RNA, 20 nt, Artificial Sequence
  Guide Sequence
gccaaccccagugccacccc

SEQ ID NO: 3615 - RNA, 20 nt, Artificial Sequence
  Guide Sequence
ggagccaaccccagugccac

SEQ ID NO: 3616 - RNA, 20 nt, Artificial Sequence
  Guide Sequence
ggcaccuguaccuccggggu

SEQ ID NO: 3617 - RNA, 20 nt, Artificial Sequence
  Guide Sequence
ggcacugggguuggcuccau

SEQ ID NO: 3618 - RNA, 20 nt, Artificial Sequence
  Guide Sequence
gggguggcacugggguuggc

SEQ ID NO: 3619 - RNA, 20 nt, Artificial Sequence
  Guide Sequence
ggguggcacugggguuggcu

SEQ ID NO: 3620 - RNA, 20 nt, Artificial Sequence
  Guide Sequence
ggucauggagccaaccccag

SEQ ID NO: 3621 - RNA, 20 nt, Artificial Sequence
  Guide Sequence
gguggcacugggguuggcuc

SEQ ID NO: 3622 - RNA, 20 nt, Artificial Sequence
  Guide Sequence
guaccuccgggguggcacug

SEQ ID NO: 3623 - RNA, 20 nt, Artificial Sequence
  Guide Sequence
gucauggagccaaccccagu

SEQ ID NO: 3624 - RNA, 20 nt, Artificial Sequence
  Guide Sequence
gugccaccccggagguacag

SEQ ID NO: 3625 - RNA, 20 nt, Artificial Sequence
  Guide Sequence
guggcacugggguuggcucc

SEQ ID NO: 3626 - RNA, 20 nt, Artificial Sequence
  Guide Sequence
uaccuccgggguggcacugg

SEQ ID NO: 3627 - RNA, 20 nt, Artificial Sequence
  Guide Sequence
ucauggagccaaccccagug

SEQ ID NO: 3628 - RNA, 20 nt, Artificial Sequence
  Guide Sequence
uccgggguggcacugggguu

SEQ ID NO: 3629 - RNA, 20 nt, Artificial Sequence
  Guide Sequence
uggagccaaccccagugcca

SEQ ID NO: 3630 - RNA, 20 nt, Artificial Sequence
  Guide Sequence
uggcacugggguuggcucca

SEQ ID NO: 3631 - RNA, 20 nt, Artificial Sequence
  Guide Sequence
uggucauggagccaacccca

SEQ ID NO: 3632 - RNA, 20 nt, Artificial Sequence
  Guide Sequence
uguaccuccgggguggcacu

SEQ ID NO: 3633 - RNA, 20 nt, Artificial Sequence
  Guide Sequence
uuggucauggagccaacccc

SEQ ID NO: 3634 - RNA, 21 nt, Artificial Sequence
  Guide Sequence
aaccccagugccaccccggag

SEQ ID NO: 3635 - RNA, 21 nt, Artificial Sequence
  Guide Sequence
accccagugccaccccggagg

SEQ ID NO: 3636 - RNA, 21 nt, Artificial Sequence
  Guide Sequence
accuccgggguggcacugggg

SEQ ID NO: 3637 - RNA, 21 nt, Artificial Sequence
  Guide Sequence
accuguaccuccgggguggca

SEQ ID NO: 3638 - RNA, 21 nt, Artificial Sequence
  Guide Sequence
agccaaccccagugccacccc

SEQ ID NO: 3639 - RNA, 21 nt, Artificial Sequence
  Guide Sequence
agugccaccccggagguacag

SEQ ID NO: 3640 - RNA, 21 nt, Artificial Sequence
  Guide Sequence
auggagccaaccccagugcca

SEQ ID NO: 3641 - RNA, 21 nt, Artificial Sequence
  Guide Sequence
caaccccagugccaccccgga

SEQ ID NO: 3642 - RNA, 21 nt, Artificial Sequence
  Guide Sequence
caccuguaccuccgggguggc

SEQ ID NO: 3643 - RNA, 21 nt, Artificial Sequence
  Guide Sequence
cacugggguuggcuccaugac

SEQ ID NO: 3644 - RNA, 21 nt, Artificial Sequence
  Guide Sequence
cagugccaccccggagguaca

SEQ ID NO: 3645 - RNA, 21 nt, Artificial Sequence
  Guide Sequence
cauggagccaaccccagugcc

SEQ ID NO: 3646 - RNA, 21 nt, Artificial Sequence
  Guide Sequence
ccaaccccagugccaccccgg

SEQ ID NO: 3647 - RNA, 21 nt, Artificial Sequence
  Guide Sequence
ccagugccaccccggagguac

SEQ ID NO: 3648 - RNA, 21 nt, Artificial Sequence
  Guide Sequence
cccagugccaccccggaggua

SEQ ID NO: 3649 - RNA, 21 nt, Artificial Sequence
  Guide Sequence
ccccagugccaccccggaggu

SEQ ID NO: 3650 - RNA, 21 nt, Artificial Sequence
  Guide Sequence
ccgggguggcacugggguugg

SEQ ID NO: 3651 - RNA, 21 nt, Artificial Sequence
  Guide Sequence
ccuccgggguggcacuggggu

SEQ ID NO: 3652 - RNA, 21 nt, Artificial Sequence
  Guide Sequence
ccuguaccuccgggguggcac

SEQ ID NO: 3653 - RNA, 21 nt, Artificial Sequence
  Guide Sequence
cggcaccuguaccuccggggu

SEQ ID NO: 3654 - RNA, 21 nt, Artificial Sequence
  Guide Sequence
cgggguggcacugggguuggc

SEQ ID NO: 3655 - RNA, 21 nt, Artificial Sequence
  Guide Sequence
cuccgggguggcacugggguu

SEQ ID NO: 3656 - RNA, 21 nt, Artificial Sequence
  Guide Sequence
cuguaccuccgggguggcacu

SEQ ID NO: 3657 - RNA, 21 nt, Artificial Sequence
  Guide Sequence
cuuggucauggagccaacccc

SEQ ID NO: 3658 - RNA, 21 nt, Artificial Sequence
  Guide Sequence
gagccaaccccagugccaccc

SEQ ID NO: 3659 - RNA, 21 nt, Artificial Sequence
  Guide Sequence
gcaccuguaccuccggggugg

SEQ ID NO: 3660 - RNA, 21 nt, Artificial Sequence
  Guide Sequence
gcacugggguuggcuccauga

SEQ ID NO: 3661 - RNA, 21 nt, Artificial Sequence
  Guide Sequence
gccaaccccagugccaccccg

SEQ ID NO: 3662 - RNA, 21 nt, Artificial Sequence
  Guide Sequence
ggagccaaccccagugccacc

SEQ ID NO: 3663 - RNA, 21 nt, Artificial Sequence
  Guide Sequence
ggcaccuguaccuccggggug

SEQ ID NO: 3664 - RNA, 21 nt, Artificial Sequence
  Guide Sequence
ggcacugggguuggcuccaug

SEQ ID NO: 3665 - RNA, 21 nt, Artificial Sequence
  Guide Sequence
gggguggcacugggguuggcu

SEQ ID NO: 3666 - RNA, 21 nt, Artificial Sequence
  Guide Sequence
ggguggcacugggguuggcuc

SEQ ID NO: 3667 - RNA, 21 nt, Artificial Sequence
  Guide Sequence
ggucauggagccaaccccagu

SEQ ID NO: 3668 - RNA, 21 nt, Artificial Sequence
  Guide Sequence
gguggcacugggguuggcucc

SEQ ID NO: 3669 - RNA, 21 nt, Artificial Sequence
  Guide Sequence
guaccuccgggguggcacugg

SEQ ID NO: 3670 - RNA, 21 nt, Artificial Sequence
  Guide Sequence
gucauggagccaaccccagug

SEQ ID NO: 3671 - RNA, 21 nt, Artificial Sequence
  Guide Sequence
gugccaccccggagguacagg

SEQ ID NO: 3672 - RNA, 21 nt, Artificial Sequence
  Guide Sequence
guggcacugggguuggcucca

SEQ ID NO: 3673 - RNA, 21 nt, Artificial Sequence
  Guide Sequence
uaccuccgggguggcacuggg

SEQ ID NO: 3674 - RNA, 21 nt, Artificial Sequence
  Guide Sequence
ucauggagccaaccccagugc

SEQ ID NO: 3675 - RNA, 21 nt, Artificial Sequence
  Guide Sequence
uccgggguggcacugggguug

SEQ ID NO: 3676 - RNA, 21 nt, Artificial Sequence
  Guide Sequence
ucuuggucauggagccaaccc

SEQ ID NO: 3677 - RNA, 21 nt, Artificial Sequence
  Guide Sequence
uggagccaaccccagugccac

SEQ ID NO: 3678 - RNA, 21 nt, Artificial Sequence
  Guide Sequence
uggcacugggguuggcuccau

SEQ ID NO: 3679 - RNA, 21 nt, Artificial Sequence
  Guide Sequence
uggucauggagccaaccccag

SEQ ID NO: 3680 - RNA, 21 nt, Artificial Sequence
  Guide Sequence
uguaccuccgggguggcacug

SEQ ID NO: 3681 - RNA, 21 nt, Artificial Sequence
  Guide Sequence
uuggucauggagccaacccca

SEQ ID NO: 3682 - RNA, 22 nt, Artificial Sequence
  Guide Sequence
aaccccagugccaccccggagg

SEQ ID NO: 3683 - RNA, 22 nt, Artificial Sequence
  Guide Sequence
accccagugccaccccggaggu

SEQ ID NO: 3684 - RNA, 22 nt, Artificial Sequence
  Guide Sequence
accuccgggguggcacuggggu

SEQ ID NO: 3685 - RNA, 22 nt, Artificial Sequence
  Guide Sequence
accuguaccuccgggguggcac

SEQ ID NO: 3686 - RNA, 22 nt, Artificial Sequence
  Guide Sequence
agccaaccccagugccaccccg

SEQ ID NO: 3687 - RNA, 22 nt, Artificial Sequence
  Guide Sequence
agugccaccccggagguacagg

SEQ ID NO: 3688 - RNA, 22 nt, Artificial Sequence
  Guide Sequence
aucuuggucauggagccaaccc

SEQ ID NO: 3689 - RNA, 22 nt, Artificial Sequence
  Guide Sequence
auggagccaaccccagugccac

SEQ ID NO: 3690 - RNA, 22 nt, Artificial Sequence
  Guide Sequence
caaccccagugccaccccggag

SEQ ID NO: 3691 - RNA, 22 nt, Artificial Sequence
  Guide Sequence
caccuguaccuccgggguggca

SEQ ID NO: 3692 - RNA, 22 nt, Artificial Sequence
  Guide Sequence
cacugggguuggcuccaugacc

SEQ ID NO: 3693 - RNA, 22 nt, Artificial Sequence
  Guide Sequence
cagugccaccccggagguacag

SEQ ID NO: 3694 - RNA, 22 nt, Artificial Sequence
  Guide Sequence
cauggagccaaccccagugcca

SEQ ID NO: 3695 - RNA, 22 nt, Artificial Sequence
  Guide Sequence
ccaaccccagugccaccccgga

SEQ ID NO: 3696 - RNA, 22 nt, Artificial Sequence
  Guide Sequence
ccagugccaccccggagguaca

SEQ ID NO: 3697 - RNA, 22 nt, Artificial Sequence
  Guide Sequence
cccagugccaccccggagguac

SEQ ID NO: 3698 - RNA, 22 nt, Artificial Sequence
  Guide Sequence
ccccagugccaccccggaggua

SEQ ID NO: 3699 - RNA, 22 nt, Artificial Sequence
  Guide Sequence
ccgggguggcacugggguuggc

SEQ ID NO: 3700 - RNA, 22 nt, Artificial Sequence
  Guide Sequence
ccuccgggguggcacugggguu

SEQ ID NO: 3701 - RNA, 22 nt, Artificial Sequence
  Guide Sequence
ccuguaccuccgggguggcacu

SEQ ID NO: 3702 - RNA, 22 nt, Artificial Sequence
  Guide Sequence
cggcaccuguaccuccggggug

SEQ ID NO: 3703 - RNA, 22 nt, Artificial Sequence
  Guide Sequence
cgggguggcacugggguuggcu

SEQ ID NO: 3704 - RNA, 22 nt, Artificial Sequence
  Guide Sequence
cuccgggguggcacugggguug

SEQ ID NO: 3705 - RNA, 22 nt, Artificial Sequence
  Guide Sequence
cuguaccuccgggguggcacug

SEQ ID NO: 3706 - RNA, 22 nt, Artificial Sequence
  Guide Sequence
cuuggucauggagccaacccca

SEQ ID NO: 3707 - RNA, 22 nt, Artificial Sequence
  Guide Sequence
gagccaaccccagugccacccc

SEQ ID NO: 3708 - RNA, 22 nt, Artificial Sequence
  Guide Sequence
gcaccuguaccuccgggguggc

SEQ ID NO: 3709 - RNA, 22 nt, Artificial Sequence
  Guide Sequence
gcacugggguuggcuccaugac

SEQ ID NO: 3710 - RNA, 22 nt, Artificial Sequence
  Guide Sequence
gccaaccccagugccaccccgg

SEQ ID NO: 3711 - RNA, 22 nt, Artificial Sequence
  Guide Sequence
gcggcaccuguaccuccggggu

SEQ ID NO: 3712 - RNA, 22 nt, Artificial Sequence
  Guide Sequence
ggagccaaccccagugccaccc

SEQ ID NO: 3713 - RNA, 22 nt, Artificial Sequence
  Guide Sequence
ggcaccuguaccuccggggugg

SEQ ID NO: 3714 - RNA, 22 nt, Artificial Sequence
  Guide Sequence
ggcacugggguuggcuccauga

SEQ ID NO: 3715 - RNA, 22 nt, Artificial Sequence
  Guide Sequence
gggguggcacugggguuggcuc

SEQ ID NO: 3716 - RNA, 22 nt, Artificial Sequence
  Guide Sequence
ggguggcacugggguuggcucc

SEQ ID NO: 3717 - RNA, 22 nt, Artificial Sequence
  Guide Sequence
ggucauggagccaaccccagug

SEQ ID NO: 3718 - RNA, 22 nt, Artificial Sequence
  Guide Sequence
gguggcacugggguuggcucca

SEQ ID NO: 3719 - RNA, 22 nt, Artificial Sequence
  Guide Sequence
guaccuccgggguggcacuggg

SEQ ID NO: 3720 - RNA, 22 nt, Artificial Sequence
  Guide Sequence
gucauggagccaaccccagugc

SEQ ID NO: 3721 - RNA, 22 nt, Artificial Sequence
  Guide Sequence
gugccaccccggagguacaggu

SEQ ID NO: 3722 - RNA, 22 nt, Artificial Sequence
  Guide Sequence
guggcacugggguuggcuccau

SEQ ID NO: 3723 - RNA, 22 nt, Artificial Sequence
  Guide Sequence
uaccuccgggguggcacugggg

SEQ ID NO: 3724 - RNA, 22 nt, Artificial Sequence
  Guide Sequence
ucauggagccaaccccagugcc

SEQ ID NO: 3725 - RNA, 22 nt, Artificial Sequence
  Guide Sequence
uccgggguggcacugggguugg

SEQ ID NO: 3726 - RNA, 22 nt, Artificial Sequence
  Guide Sequence
ucuuggucauggagccaacccc

SEQ ID NO: 3727 - RNA, 22 nt, Artificial Sequence
  Guide Sequence
uggagccaaccccagugccacc

SEQ ID NO: 3728 - RNA, 22 nt, Artificial Sequence
  Guide Sequence
uggcacugggguuggcuccaug

SEQ ID NO: 3729 - RNA, 22 nt, Artificial Sequence
  Guide Sequence
uggucauggagccaaccccagu

SEQ ID NO: 3730 - RNA, 22 nt, Artificial Sequence
  Guide Sequence
uguaccuccgggguggcacugg

SEQ ID NO: 3731 - RNA, 22 nt, Artificial Sequence
  Guide Sequence
uuggucauggagccaaccccag

SEQ ID NO: 3732 - RNA, 20 nt, Artificial Sequence
  Guide Sequence
aagaucuaugggggacguca

SEQ ID NO: 3733 - RNA, 20 nt, Artificial Sequence
  Guide Sequence
acgccguuucacugacgucc

SEQ ID NO: 3734 - RNA, 20 nt, Artificial Sequence
  Guide Sequence
acgucagugaaacggcguca

SEQ ID NO: 3735 - RNA, 20 nt, Artificial Sequence
  Guide Sequence
agaucuaugggggacgucag

SEQ ID NO: 3736 - RNA, 20 nt, Artificial Sequence
  Guide Sequence
agugaaacggcgucaugccc

SEQ ID NO: 3737 - RNA, 20 nt, Artificial Sequence
  Guide Sequence
aucuaugggggacgucagug

SEQ ID NO: 3738 - RNA, 20 nt, Artificial Sequence
  Guide Sequence
augacgccguuucacugacg

SEQ ID NO: 3739 - RNA, 20 nt, Artificial Sequence
  Guide Sequence
augggggacgucagugaaac

SEQ ID NO: 3740 - RNA, 20 nt, Artificial Sequence
  Guide Sequence
caagaucuaugggggacguc

SEQ ID NO: 3741 - RNA, 20 nt, Artificial Sequence
  Guide Sequence
cacugacgucccccauagau

SEQ ID NO: 3742 - RNA, 20 nt, Artificial Sequence
  Guide Sequence
cagugaaacggcgucaugcc

SEQ ID NO: 3743 - RNA, 20 nt, Artificial Sequence
  Guide Sequence
caugacgccguuucacugac

SEQ ID NO: 3744 - RNA, 20 nt, Artificial Sequence
  Guide Sequence
ccaagaucuaugggggacgu

SEQ ID NO: 3745 - RNA, 20 nt, Artificial Sequence
  Guide Sequence
ccguuucacugacguccccc

SEQ ID NO: 3746 - RNA, 20 nt, Artificial Sequence
  Guide Sequence
cgccguuucacugacguccc

SEQ ID NO: 3747 - RNA, 20 nt, Artificial Sequence
  Guide Sequence
cgucagugaaacggcgucau

SEQ ID NO: 3748 - RNA, 20 nt, Artificial Sequence
  Guide Sequence
cguuucacugacguccccca

SEQ ID NO: 3749 - RNA, 20 nt, Artificial Sequence
  Guide Sequence
cuaugggggacgucagugaa

SEQ ID NO: 3750 - RNA, 20 nt, Artificial Sequence
  Guide Sequence
cugggcaugacgccguuuca

SEQ ID NO: 3751 - RNA, 20 nt, Artificial Sequence
  Guide Sequence
gacgccguuucacugacguc

SEQ ID NO: 3752 - RNA, 20 nt, Artificial Sequence
  Guide Sequence
gacgucagugaaacggcguc

SEQ ID NO: 3753 - RNA, 20 nt, Artificial Sequence
  Guide Sequence
gaucuaugggggacgucagu

SEQ ID NO: 3754 - RNA, 20 nt, Artificial Sequence
  Guide Sequence
gcaugacgccguuucacuga

SEQ ID NO: 3755 - RNA, 20 nt, Artificial Sequence
  Guide Sequence
gccguuucacugacgucccc

SEQ ID NO: 3756 - RNA, 20 nt, Artificial Sequence
  Guide Sequence
gcugggcaugacgccguuuc

SEQ ID NO: 3757 - RNA, 20 nt, Artificial Sequence
  Guide Sequence
ggacgucagugaaacggcgu

SEQ ID NO: 3758 - RNA, 20 nt, Artificial Sequence
  Guide Sequence
ggcaugacgccguuucacug

SEQ ID NO: 3759 - RNA, 20 nt, Artificial Sequence
  Guide Sequence
ggcugggcaugacgccguuu

SEQ ID NO: 3760 - RNA, 20 nt, Artificial Sequence
  Guide Sequence
gggacgucagugaaacggcg

SEQ ID NO: 3761 - RNA, 20 nt, Artificial Sequence
  Guide Sequence
gggcaugacgccguuucacu

SEQ ID NO: 3762 - RNA, 20 nt, Artificial Sequence
  Guide Sequence
ggggacgucagugaaacggc

SEQ ID NO: 3763 - RNA, 20 nt, Artificial Sequence
  Guide Sequence
gggggacgucagugaaacgg

SEQ ID NO: 3764 - RNA, 20 nt, Artificial Sequence
  Guide Sequence
gucagugaaacggcgucaug

SEQ ID NO: 3765 - RNA, 20 nt, Artificial Sequence
  Guide Sequence
gugaaacggcgucaugccca

SEQ ID NO: 3766 - RNA, 20 nt, Artificial Sequence
  Guide Sequence
guggcugggcaugacgccgu

SEQ ID NO: 3767 - RNA, 20 nt, Artificial Sequence
  Guide Sequence
guuucacugacgucccccau

SEQ ID NO: 3768 - RNA, 20 nt, Artificial Sequence
  Guide Sequence
uaugggggacgucagugaaa

SEQ ID NO: 3769 - RNA, 20 nt, Artificial Sequence
  Guide Sequence
ucacugacgucccccauaga

SEQ ID NO: 3770 - RNA, 20 nt, Artificial Sequence
  Guide Sequence
ucagugaaacggcgucaugc

SEQ ID NO: 3771 - RNA, 20 nt, Artificial Sequence
  Guide Sequence
ucuaugggggacgucaguga

SEQ ID NO: 3772 - RNA, 20 nt, Artificial Sequence
  Guide Sequence
ugacgccguuucacugacgu

SEQ ID NO: 3773 - RNA, 20 nt, Artificial Sequence
  Guide Sequence
uggcugggcaugacgccguu

SEQ ID NO: 3774 - RNA, 20 nt, Artificial Sequence
  Guide Sequence
ugggcaugacgccguuucac

SEQ ID NO: 3775 - RNA, 20 nt, Artificial Sequence
  Guide Sequence
ugggggacgucagugaaacg

SEQ ID NO: 3776 - RNA, 20 nt, Artificial Sequence
  Guide Sequence
uucacugacgucccccauag

SEQ ID NO: 3777 - RNA, 20 nt, Artificial Sequence
  Guide Sequence
uuucacugacgucccccaua

SEQ ID NO: 3778 - RNA, 21 nt, Artificial Sequence
  Guide Sequence
aagaucuaugggggacgucag

SEQ ID NO: 3779 - RNA, 21 nt, Artificial Sequence
  Guide Sequence
accaagaucuaugggggacgu

SEQ ID NO: 3780 - RNA, 21 nt, Artificial Sequence
  Guide Sequence
acgccguuucacugacguccc

SEQ ID NO: 3781 - RNA, 21 nt, Artificial Sequence
  Guide Sequence
acgucagugaaacggcgucau

SEQ ID NO: 3782 - RNA, 21 nt, Artificial Sequence
  Guide Sequence
agaucuaugggggacgucagu

SEQ ID NO: 3783 - RNA, 21 nt, Artificial Sequence
  Guide Sequence
agugaaacggcgucaugccca

SEQ ID NO: 3784 - RNA, 21 nt, Artificial Sequence
  Guide Sequence
aguggcugggcaugacgccgu

SEQ ID NO: 3785 - RNA, 21 nt, Artificial Sequence
  Guide Sequence
aucuaugggggacgucaguga

SEQ ID NO: 3786 - RNA, 21 nt, Artificial Sequence
  Guide Sequence
augacgccguuucacugacgu

SEQ ID NO: 3787 - RNA, 21 nt, Artificial Sequence
  Guide Sequence
augggggacgucagugaaacg

SEQ ID NO: 3788 - RNA, 21 nt, Artificial Sequence
  Guide Sequence
caagaucuaugggggacguca

SEQ ID NO: 3789 - RNA, 21 nt, Artificial Sequence
  Guide Sequence
cacugacgucccccauagauc

SEQ ID NO: 3790 - RNA, 21 nt, Artificial Sequence
  Guide Sequence
cagugaaacggcgucaugccc

SEQ ID NO: 3791 - RNA, 21 nt, Artificial Sequence
  Guide Sequence
caugacgccguuucacugacg

SEQ ID NO: 3792 - RNA, 21 nt, Artificial Sequence
  Guide Sequence
ccaagaucuaugggggacguc

SEQ ID NO: 3793 - RNA, 21 nt, Artificial Sequence
  Guide Sequence
ccguuucacugacguccccca

SEQ ID NO: 3794 - RNA, 21 nt, Artificial Sequence
  Guide Sequence
cgccguuucacugacgucccc

SEQ ID NO: 3795 - RNA, 21 nt, Artificial Sequence
  Guide Sequence
cgucagugaaacggcgucaug

SEQ ID NO: 3796 - RNA, 21 nt, Artificial Sequence
  Guide Sequence
cguuucacugacgucccccau

SEQ ID NO: 3797 - RNA, 21 nt, Artificial Sequence
  Guide Sequence
cuaugggggacgucagugaaa

SEQ ID NO: 3798 - RNA, 21 nt, Artificial Sequence
  Guide Sequence
cugggcaugacgccguuucac

SEQ ID NO: 3799 - RNA, 21 nt, Artificial Sequence
  Guide Sequence
gacgccguuucacugacgucc

SEQ ID NO: 3800 - RNA, 21 nt, Artificial Sequence
  Guide Sequence
gacgucagugaaacggcguca

SEQ ID NO: 3801 - RNA, 21 nt, Artificial Sequence
  Guide Sequence
gaucuaugggggacgucagug

SEQ ID NO: 3802 - RNA, 21 nt, Artificial Sequence
  Guide Sequence
gcaugacgccguuucacugac

SEQ ID NO: 3803 - RNA, 21 nt, Artificial Sequence
  Guide Sequence
gccguuucacugacguccccc

SEQ ID NO: 3804 - RNA, 21 nt, Artificial Sequence
  Guide Sequence
gcugggcaugacgccguuuca

SEQ ID NO: 3805 - RNA, 21 nt, Artificial Sequence
  Guide Sequence
ggacgucagugaaacggcguc

SEQ ID NO: 3806 - RNA, 21 nt, Artificial Sequence
  Guide Sequence
ggcaugacgccguuucacuga

SEQ ID NO: 3807 - RNA, 21 nt, Artificial Sequence
  Guide Sequence
ggcugggcaugacgccguuuc

SEQ ID NO: 3808 - RNA, 21 nt, Artificial Sequence
  Guide Sequence
gggacgucagugaaacggcgu

SEQ ID NO: 3809 - RNA, 21 nt, Artificial Sequence
  Guide Sequence
gggcaugacgccguuucacug

SEQ ID NO: 3810 - RNA, 21 nt, Artificial Sequence
  Guide Sequence
ggggacgucagugaaacggcg

SEQ ID NO: 3811 - RNA, 21 nt, Artificial Sequence
  Guide Sequence
gggggacgucagugaaacggc

SEQ ID NO: 3812 - RNA, 21 nt, Artificial Sequence
  Guide Sequence
gucagugaaacggcgucaugc

SEQ ID NO: 3813 - RNA, 21 nt, Artificial Sequence
  Guide Sequence
gugaaacggcgucaugcccag

SEQ ID NO: 3814 - RNA, 21 nt, Artificial Sequence
  Guide Sequence
guggcugggcaugacgccguu

SEQ ID NO: 3815 - RNA, 21 nt, Artificial Sequence
  Guide Sequence
guuucacugacgucccccaua

SEQ ID NO: 3816 - RNA, 21 nt, Artificial Sequence
  Guide Sequence
uaugggggacgucagugaaac

SEQ ID NO: 3817 - RNA, 21 nt, Artificial Sequence
  Guide Sequence
ucacugacgucccccauagau

SEQ ID NO: 3818 - RNA, 21 nt, Artificial Sequence
  Guide Sequence
ucagugaaacggcgucaugcc

SEQ ID NO: 3819 - RNA, 21 nt, Artificial Sequence
  Guide Sequence
ucuaugggggacgucagugaa

SEQ ID NO: 3820 - RNA, 21 nt, Artificial Sequence
  Guide Sequence
ugacgccguuucacugacguc

SEQ ID NO: 3821 - RNA, 21 nt, Artificial Sequence
  Guide Sequence
uggcugggcaugacgccguuu

SEQ ID NO: 3822 - RNA, 21 nt, Artificial Sequence
  Guide Sequence
ugggcaugacgccguuucacu

SEQ ID NO: 3823 - RNA, 21 nt, Artificial Sequence
  Guide Sequence
ugggggacgucagugaaacgg

SEQ ID NO: 3824 - RNA, 21 nt, Artificial Sequence
  Guide Sequence
uucacugacgucccccauaga

SEQ ID NO: 3825 - RNA, 21 nt, Artificial Sequence
  Guide Sequence
uuucacugacgucccccauag

SEQ ID NO: 3826 - RNA, 22 nt, Artificial Sequence
  Guide Sequence
aagaucuaugggggacgucagu

SEQ ID NO: 3827 - RNA, 22 nt, Artificial Sequence
  Guide Sequence
aaguggcugggcaugacgccgu

SEQ ID NO: 3828 - RNA, 22 nt, Artificial Sequence
  Guide Sequence
accaagaucuaugggggacguc

SEQ ID NO: 3829 - RNA, 22 nt, Artificial Sequence
  Guide Sequence
acgccguuucacugacgucccc

SEQ ID NO: 3830 - RNA, 22 nt, Artificial Sequence
  Guide Sequence
acgucagugaaacggcgucaug

SEQ ID NO: 3831 - RNA, 22 nt, Artificial Sequence
  Guide Sequence
agaucuaugggggacgucagug

SEQ ID NO: 3832 - RNA, 22 nt, Artificial Sequence
  Guide Sequence
agugaaacggcgucaugcccag

SEQ ID NO: 3833 - RNA, 22 nt, Artificial Sequence
  Guide Sequence
aguggcugggcaugacgccguu

SEQ ID NO: 3834 - RNA, 22 nt, Artificial Sequence
  Guide Sequence
aucuaugggggacgucagugaa

SEQ ID NO: 3835 - RNA, 22 nt, Artificial Sequence
  Guide Sequence
augacgccguuucacugacguc

SEQ ID NO: 3836 - RNA, 22 nt, Artificial Sequence
  Guide Sequence
augggggacgucagugaaacgg

SEQ ID NO: 3837 - RNA, 22 nt, Artificial Sequence
  Guide Sequence
caagaucuaugggggacgucag

SEQ ID NO: 3838 - RNA, 22 nt, Artificial Sequence
  Guide Sequence
cacugacgucccccauagaucu

SEQ ID NO: 3839 - RNA, 22 nt, Artificial Sequence
  Guide Sequence
cagugaaacggcgucaugccca

SEQ ID NO: 3840 - RNA, 22 nt, Artificial Sequence
  Guide Sequence
caugacgccguuucacugacgu

SEQ ID NO: 3841 - RNA, 22 nt, Artificial Sequence
  Guide Sequence
ccaagaucuaugggggacguca

SEQ ID NO: 3842 - RNA, 22 nt, Artificial Sequence
  Guide Sequence
ccguuucacugacgucccccau

SEQ ID NO: 3843 - RNA, 22 nt, Artificial Sequence
  Guide Sequence
cgccguuucacugacguccccc

SEQ ID NO: 3844 - RNA, 22 nt, Artificial Sequence
  Guide Sequence
cgucagugaaacggcgucaugc

SEQ ID NO: 3845 - RNA, 22 nt, Artificial Sequence
  Guide Sequence
cguuucacugacgucccccaua

SEQ ID NO: 3846 - RNA, 22 nt, Artificial Sequence
  Guide Sequence
cuaugggggacgucagugaaac

SEQ ID NO: 3847 - RNA, 22 nt, Artificial Sequence
  Guide Sequence
cugggcaugacgccguuucacu

SEQ ID NO: 3848 - RNA, 22 nt, Artificial Sequence
  Guide Sequence
gaccaagaucuaugggggacgu

SEQ ID NO: 3849 - RNA, 22 nt, Artificial Sequence
  Guide Sequence
gacgccguuucacugacguccc

SEQ ID NO: 3850 - RNA, 22 nt, Artificial Sequence
  Guide Sequence
gacgucagugaaacggcgucau

SEQ ID NO: 3851 - RNA, 22 nt, Artificial Sequence
  Guide Sequence
gaucuaugggggacgucaguga

SEQ ID NO: 3852 - RNA, 22 nt, Artificial Sequence
  Guide Sequence
gcaugacgccguuucacugacg

SEQ ID NO: 3853 - RNA, 22 nt, Artificial Sequence
  Guide Sequence
gccguuucacugacguccccca

SEQ ID NO: 3854 - RNA, 22 nt, Artificial Sequence
  Guide Sequence
gcugggcaugacgccguuucac

SEQ ID NO: 3855 - RNA, 22 nt, Artificial Sequence
  Guide Sequence
ggacgucagugaaacggcguca

SEQ ID NO: 3856 - RNA, 22 nt, Artificial Sequence
  Guide Sequence
ggcaugacgccguuucacugac

SEQ ID NO: 3857 - RNA, 22 nt, Artificial Sequence
  Guide Sequence
ggcugggcaugacgccguuuca

SEQ ID NO: 3858 - RNA, 22 nt, Artificial Sequence
  Guide Sequence
gggacgucagugaaacggcguc

SEQ ID NO: 3859 - RNA, 22 nt, Artificial Sequence
  Guide Sequence
gggcaugacgccguuucacuga

SEQ ID NO: 3860 - RNA, 22 nt, Artificial Sequence
  Guide Sequence
ggggacgucagugaaacggcgu

SEQ ID NO: 3861 - RNA, 22 nt, Artificial Sequence
  Guide Sequence
gggggacgucagugaaacggcg

SEQ ID NO: 3862 - RNA, 22 nt, Artificial Sequence
  Guide Sequence
gucagugaaacggcgucaugcc

SEQ ID NO: 3863 - RNA, 22 nt, Artificial Sequence
  Guide Sequence
gugaaacggcgucaugcccagc

SEQ ID NO: 3864 - RNA, 22 nt, Artificial Sequence
  Guide Sequence
guggcugggcaugacgccguuu

SEQ ID NO: 3865 - RNA, 22 nt, Artificial Sequence
  Guide Sequence
guuucacugacgucccccauag

SEQ ID NO: 3866 - RNA, 22 nt, Artificial Sequence
  Guide Sequence
uaugggggacgucagugaaacg

SEQ ID NO: 3867 - RNA, 22 nt, Artificial Sequence
  Guide Sequence
ucacugacgucccccauagauc

SEQ ID NO: 3868 - RNA, 22 nt, Artificial Sequence
  Guide Sequence
ucagugaaacggcgucaugccc

SEQ ID NO: 3869 - RNA, 22 nt, Artificial Sequence
  Guide Sequence
ucuaugggggacgucagugaaa

SEQ ID NO: 3870 - RNA, 22 nt, Artificial Sequence
  Guide Sequence
ugacgccguuucacugacgucc

SEQ ID NO: 3871 - RNA, 22 nt, Artificial Sequence
  Guide Sequence
uggcugggcaugacgccguuuc

SEQ ID NO: 3872 - RNA, 22 nt, Artificial Sequence
  Guide Sequence
ugggcaugacgccguuucacug

SEQ ID NO: 3873 - RNA, 22 nt, Artificial Sequence
  Guide Sequence
ugggggacgucagugaaacggc

SEQ ID NO: 3874 - RNA, 22 nt, Artificial Sequence
  Guide Sequence
uucacugacgucccccauagau

SEQ ID NO: 3875 - RNA, 22 nt, Artificial Sequence
  Guide Sequence
uuucacugacgucccccauaga

SEQ ID NO: 3876 - RNA, 20 nt, Artificial Sequence
  Guide Sequence
acacucuuggagccucagcu

SEQ ID NO: 3877 - RNA, 20 nt, Artificial Sequence
  Guide Sequence
acucuuggagccucagcuga

SEQ ID NO: 3878 - RNA, 20 nt, Artificial Sequence
  Guide Sequence
acuucagcugaggcuccaag

SEQ ID NO: 3879 - RNA, 20 nt, Artificial Sequence
  Guide Sequence
agccacuucagcugaggcuc

SEQ ID NO: 3880 - RNA, 20 nt, Artificial Sequence
  Guide Sequence
agccucagcugaaguggcug

SEQ ID NO: 3881 - RNA, 20 nt, Artificial Sequence
  Guide Sequence
agcugaggcuccaagagugu

SEQ ID NO: 3882 - RNA, 20 nt, Artificial Sequence
  Guide Sequence
augcccagccacuucagcug

SEQ ID NO: 3883 - RNA, 20 nt, Artificial Sequence
  Guide Sequence
cacacucuuggagccucagc

SEQ ID NO: 3884 - RNA, 20 nt, Artificial Sequence
  Guide Sequence
cacucuuggagccucagcug

SEQ ID NO: 3885 - RNA, 20 nt, Artificial Sequence
  Guide Sequence
cacuucagcugaggcuccaa

SEQ ID NO: 3886 - RNA, 20 nt, Artificial Sequence
  Guide Sequence
cagccacuucagcugaggcu

SEQ ID NO: 3887 - RNA, 20 nt, Artificial Sequence
  Guide Sequence
cagcugaaguggcugggcau

SEQ ID NO: 3888 - RNA, 20 nt, Artificial Sequence
  Guide Sequence
cagcugaggcuccaagagug

SEQ ID NO: 3889 - RNA, 20 nt, Artificial Sequence
  Guide Sequence
caugcccagccacuucagcu

SEQ ID NO: 3890 - RNA, 20 nt, Artificial Sequence
  Guide Sequence
ccacacucuuggagccucag

SEQ ID NO: 3891 - RNA, 20 nt, Artificial Sequence
  Guide Sequence
ccacuucagcugaggcucca

SEQ ID NO: 3892 - RNA, 20 nt, Artificial Sequence
  Guide Sequence
ccagccacuucagcugaggc

SEQ ID NO: 3893 - RNA, 20 nt, Artificial Sequence
  Guide Sequence
cccagccacuucagcugagg

SEQ ID NO: 3894 - RNA, 20 nt, Artificial Sequence
  Guide Sequence
ccucagcugaaguggcuggg

SEQ ID NO: 3895 - RNA, 20 nt, Artificial Sequence
  Guide Sequence
cgggccacacucuuggagcc

SEQ ID NO: 3896 - RNA, 20 nt, Artificial Sequence
  Guide Sequence
cgucaugcccagccacuuca

SEQ ID NO: 3897 - RNA, 20 nt, Artificial Sequence
  Guide Sequence
cucagcugaaguggcugggc

SEQ ID NO: 3898 - RNA, 20 nt, Artificial Sequence
  Guide Sequence
cucuuggagccucagcugaa

SEQ ID NO: 3899 - RNA, 20 nt, Artificial Sequence
  Guide Sequence
cugaggcuccaagagugugg

SEQ ID NO: 3900 - RNA, 20 nt, Artificial Sequence
  Guide Sequence
cuucagcugaggcuccaaga

SEQ ID NO: 3901 - RNA, 20 nt, Artificial Sequence
  Guide Sequence
cuuggagccucagcugaagu

SEQ ID NO: 3902 - RNA, 20 nt, Artificial Sequence
  Guide Sequence
gagccucagcugaaguggcu

SEQ ID NO: 3903 - RNA, 20 nt, Artificial Sequence
  Guide Sequence
gccacacucuuggagccuca

SEQ ID NO: 3904 - RNA, 20 nt, Artificial Sequence
  Guide Sequence
gccacuucagcugaggcucc

SEQ ID NO: 3905 - RNA, 20 nt, Artificial Sequence
  Guide Sequence
gcccagccacuucagcugag

SEQ ID NO: 3906 - RNA, 20 nt, Artificial Sequence
  Guide Sequence
gccucagcugaaguggcugg

SEQ ID NO: 3907 - RNA, 20 nt, Artificial Sequence
  Guide Sequence
gcgggccacacucuuggagc

SEQ ID NO: 3908 - RNA, 20 nt, Artificial Sequence
  Guide Sequence
gcgucaugcccagccacuuc

SEQ ID NO: 3909 - RNA, 20 nt, Artificial Sequence
  Guide Sequence
gcugaggcuccaagagugug

SEQ ID NO: 3910 - RNA, 20 nt, Artificial Sequence
  Guide Sequence
ggagccucagcugaaguggc

SEQ ID NO: 3911 - RNA, 20 nt, Artificial Sequence
  Guide Sequence
ggccacacucuuggagccuc

SEQ ID NO: 3912 - RNA, 20 nt, Artificial Sequence
  Guide Sequence
gggccacacucuuggagccu

SEQ ID NO: 3913 - RNA, 20 nt, Artificial Sequence
  Guide Sequence
gucaugcccagccacuucag

SEQ ID NO: 3914 - RNA, 20 nt, Artificial Sequence
  Guide Sequence
ucagcugaaguggcugggca

SEQ ID NO: 3915 - RNA, 20 nt, Artificial Sequence
  Guide Sequence
ucagcugaggcuccaagagu

SEQ ID NO: 3916 - RNA, 20 nt, Artificial Sequence
  Guide Sequence
ucaugcccagccacuucagc

SEQ ID NO: 3917 - RNA, 20 nt, Artificial Sequence
  Guide Sequence
ucuuggagccucagcugaag

SEQ ID NO: 3918 - RNA, 20 nt, Artificial Sequence
  Guide Sequence
ugcccagccacuucagcuga

SEQ ID NO: 3919 - RNA, 20 nt, Artificial Sequence
  Guide Sequence
uggagccucagcugaagugg

SEQ ID NO: 3920 - RNA, 20 nt, Artificial Sequence
  Guide Sequence
uucagcugaggcuccaagag

SEQ ID NO: 3921 - RNA, 20 nt, Artificial Sequence
  Guide Sequence
uuggagccucagcugaagug

SEQ ID NO: 3922 - RNA, 21 nt, Artificial Sequence
  Guide Sequence
acacucuuggagccucagcug

SEQ ID NO: 3923 - RNA, 21 nt, Artificial Sequence
  Guide Sequence
acucuuggagccucagcugaa

SEQ ID NO: 3924 - RNA, 21 nt, Artificial Sequence
  Guide Sequence
acuucagcugaggcuccaaga

SEQ ID NO: 3925 - RNA, 21 nt, Artificial Sequence
  Guide Sequence
agccacuucagcugaggcucc

SEQ ID NO: 3926 - RNA, 21 nt, Artificial Sequence
  Guide Sequence
agccucagcugaaguggcugg

SEQ ID NO: 3927 - RNA, 21 nt, Artificial Sequence
  Guide Sequence
agcugaggcuccaagagugug

SEQ ID NO: 3928 - RNA, 21 nt, Artificial Sequence
  Guide Sequence
augcccagccacuucagcuga

SEQ ID NO: 3929 - RNA, 21 nt, Artificial Sequence
  Guide Sequence
cacacucuuggagccucagcu

SEQ ID NO: 3930 - RNA, 21 nt, Artificial Sequence
  Guide Sequence
cacucuuggagccucagcuga

SEQ ID NO: 3931 - RNA, 21 nt, Artificial Sequence
  Guide Sequence
cacuucagcugaggcuccaag

SEQ ID NO: 3932 - RNA, 21 nt, Artificial Sequence
  Guide Sequence
cagccacuucagcugaggcuc

SEQ ID NO: 3933 - RNA, 21 nt, Artificial Sequence
  Guide Sequence
cagcugaaguggcugggcaug

SEQ ID NO: 3934 - RNA, 21 nt, Artificial Sequence
  Guide Sequence
cagcugaggcuccaagagugu

SEQ ID NO: 3935 - RNA, 21 nt, Artificial Sequence
  Guide Sequence
caugcccagccacuucagcug

SEQ ID NO: 3936 - RNA, 21 nt, Artificial Sequence
  Guide Sequence
ccacacucuuggagccucagc

SEQ ID NO: 3937 - RNA, 21 nt, Artificial Sequence
  Guide Sequence
ccacuucagcugaggcuccaa

SEQ ID NO: 3938 - RNA, 21 nt, Artificial Sequence
  Guide Sequence
ccagccacuucagcugaggcu

SEQ ID NO: 3939 - RNA, 21 nt, Artificial Sequence
  Guide Sequence
cccagccacuucagcugaggc

SEQ ID NO: 3940 - RNA, 21 nt, Artificial Sequence
  Guide Sequence
ccucagcugaaguggcugggc

SEQ ID NO: 3941 - RNA, 21 nt, Artificial Sequence
  Guide Sequence
cgggccacacucuuggagccu

SEQ ID NO: 3942 - RNA, 21 nt, Artificial Sequence
  Guide Sequence
cgucaugcccagccacuucag

SEQ ID NO: 3943 - RNA, 21 nt, Artificial Sequence
  Guide Sequence
cucagcugaaguggcugggca

SEQ ID NO: 3944 - RNA, 21 nt, Artificial Sequence
  Guide Sequence
cucuuggagccucagcugaag

SEQ ID NO: 3945 - RNA, 21 nt, Artificial Sequence
  Guide Sequence
cugaggcuccaagaguguggc

SEQ ID NO: 3946 - RNA, 21 nt, Artificial Sequence
  Guide Sequence
cuucagcugaggcuccaagag

SEQ ID NO: 3947 - RNA, 21 nt, Artificial Sequence
  Guide Sequence
cuuggagccucagcugaagug

SEQ ID NO: 3948 - RNA, 21 nt, Artificial Sequence
  Guide Sequence
gagccucagcugaaguggcug

SEQ ID NO: 3949 - RNA, 21 nt, Artificial Sequence
  Guide Sequence
gccacacucuuggagccucag

SEQ ID NO: 3950 - RNA, 21 nt, Artificial Sequence
  Guide Sequence
gccacuucagcugaggcucca

SEQ ID NO: 3951 - RNA, 21 nt, Artificial Sequence
  Guide Sequence
gcccagccacuucagcugagg

SEQ ID NO: 3952 - RNA, 21 nt, Artificial Sequence
  Guide Sequence
gccucagcugaaguggcuggg

SEQ ID NO: 3953 - RNA, 21 nt, Artificial Sequence
  Guide Sequence
gcgggccacacucuuggagcc

SEQ ID NO: 3954 - RNA, 21 nt, Artificial Sequence
  Guide Sequence
gcgucaugcccagccacuuca

SEQ ID NO: 3955 - RNA, 21 nt, Artificial Sequence
  Guide Sequence
gcugaggcuccaagagugugg

SEQ ID NO: 3956 - RNA, 21 nt, Artificial Sequence
  Guide Sequence
ggagccucagcugaaguggcu

SEQ ID NO: 3957 - RNA, 21 nt, Artificial Sequence
  Guide Sequence
ggccacacucuuggagccuca

SEQ ID NO: 3958 - RNA, 21 nt, Artificial Sequence
  Guide Sequence
ggcgggccacacucuuggagc

SEQ ID NO: 3959 - RNA, 21 nt, Artificial Sequence
  Guide Sequence
ggcgucaugcccagccacuuc

SEQ ID NO: 3960 - RNA, 21 nt, Artificial Sequence
  Guide Sequence
gggccacacucuuggagccuc

SEQ ID NO: 3961 - RNA, 21 nt, Artificial Sequence
  Guide Sequence
gucaugcccagccacuucagc

SEQ ID NO: 3962 - RNA, 21 nt, Artificial Sequence
  Guide Sequence
ucagcugaaguggcugggcau

SEQ ID NO: 3963 - RNA, 21 nt, Artificial Sequence
  Guide Sequence
ucagcugaggcuccaagagug

SEQ ID NO: 3964 - RNA, 21 nt, Artificial Sequence
  Guide Sequence
ucaugcccagccacuucagcu

SEQ ID NO: 3965 - RNA, 21 nt, Artificial Sequence
  Guide Sequence
ucuuggagccucagcugaagu

SEQ ID NO: 3966 - RNA, 21 nt, Artificial Sequence
  Guide Sequence
ugcccagccacuucagcugag

SEQ ID NO: 3967 - RNA, 21 nt, Artificial Sequence
  Guide Sequence
uggagccucagcugaaguggc

SEQ ID NO: 3968 - RNA, 21 nt, Artificial Sequence
  Guide Sequence
uucagcugaggcuccaagagu

SEQ ID NO: 3969 - RNA, 21 nt, Artificial Sequence
  Guide Sequence
uuggagccucagcugaagugg

SEQ ID NO: 3970 - RNA, 22 nt, Artificial Sequence
  Guide Sequence
acacucuuggagccucagcuga

SEQ ID NO: 3971 - RNA, 22 nt, Artificial Sequence
  Guide Sequence
acucuuggagccucagcugaag

SEQ ID NO: 3972 - RNA, 22 nt, Artificial Sequence
  Guide Sequence
acuucagcugaggcuccaagag

SEQ ID NO: 3973 - RNA, 22 nt, Artificial Sequence
  Guide Sequence
agccacuucagcugaggcucca

SEQ ID NO: 3974 - RNA, 22 nt, Artificial Sequence
  Guide Sequence
agccucagcugaaguggcuggg

SEQ ID NO: 3975 - RNA, 22 nt, Artificial Sequence
  Guide Sequence
agcugaggcuccaagagugugg

SEQ ID NO: 3976 - RNA, 22 nt, Artificial Sequence
  Guide Sequence
augcccagccacuucagcugag

SEQ ID NO: 3977 - RNA, 22 nt, Artificial Sequence
  Guide Sequence
cacacucuuggagccucagcug

SEQ ID NO: 3978 - RNA, 22 nt, Artificial Sequence
  Guide Sequence
cacucuuggagccucagcugaa

SEQ ID NO: 3979 - RNA, 22 nt, Artificial Sequence
  Guide Sequence
cacuucagcugaggcuccaaga

SEQ ID NO: 3980 - RNA, 22 nt, Artificial Sequence
  Guide Sequence
cagccacuucagcugaggcucc

SEQ ID NO: 3981 - RNA, 22 nt, Artificial Sequence
  Guide Sequence
cagcugaaguggcugggcauga

SEQ ID NO: 3982 - RNA, 22 nt, Artificial Sequence
  Guide Sequence
cagcugaggcuccaagagugug

SEQ ID NO: 3983 - RNA, 22 nt, Artificial Sequence
  Guide Sequence
caugcccagccacuucagcuga

SEQ ID NO: 3984 - RNA, 22 nt, Artificial Sequence
  Guide Sequence
ccacacucuuggagccucagcu

SEQ ID NO: 3985 - RNA, 22 nt, Artificial Sequence
  Guide Sequence
ccacuucagcugaggcuccaag

SEQ ID NO: 3986 - RNA, 22 nt, Artificial Sequence
  Guide Sequence
ccagccacuucagcugaggcuc

SEQ ID NO: 3987 - RNA, 22 nt, Artificial Sequence
  Guide Sequence
cccagccacuucagcugaggcu

SEQ ID NO: 3988 - RNA, 22 nt, Artificial Sequence
  Guide Sequence
ccucagcugaaguggcugggca

SEQ ID NO: 3989 - RNA, 22 nt, Artificial Sequence
  Guide Sequence
cggcgggccacacucuuggagc

SEQ ID NO: 3990 - RNA, 22 nt, Artificial Sequence
  Guide Sequence
cggcgucaugcccagccacuuc

SEQ ID NO: 3991 - RNA, 22 nt, Artificial Sequence
  Guide Sequence
cgggccacacucuuggagccuc

SEQ ID NO: 3992 - RNA, 22 nt, Artificial Sequence
  Guide Sequence
cgucaugcccagccacuucagc

SEQ ID NO: 3993 - RNA, 22 nt, Artificial Sequence
  Guide Sequence
cucagcugaaguggcugggcau

SEQ ID NO: 3994 - RNA, 22 nt, Artificial Sequence
  Guide Sequence
cucuuggagccucagcugaagu

SEQ ID NO: 3995 - RNA, 22 nt, Artificial Sequence
  Guide Sequence
cugaggcuccaagaguguggcc

SEQ ID NO: 3996 - RNA, 22 nt, Artificial Sequence
  Guide Sequence
cuucagcugaggcuccaagagu

SEQ ID NO: 3997 - RNA, 22 nt, Artificial Sequence
  Guide Sequence
cuuggagccucagcugaagugg

SEQ ID NO: 3998 - RNA, 22 nt, Artificial Sequence
  Guide Sequence
gagccucagcugaaguggcugg

SEQ ID NO: 3999 - RNA, 22 nt, Artificial Sequence
  Guide Sequence
gccacacucuuggagccucagc

SEQ ID NO: 4000 - RNA, 22 nt, Artificial Sequence
  Guide Sequence
gccacuucagcugaggcuccaa

SEQ ID NO: 4001 - RNA, 22 nt, Artificial Sequence
  Guide Sequence
gcccagccacuucagcugaggc

SEQ ID NO: 4002 - RNA, 22 nt, Artificial Sequence
  Guide Sequence
gccucagcugaaguggcugggc

SEQ ID NO: 4003 - RNA, 22 nt, Artificial Sequence
  Guide Sequence
gcgggccacacucuuggagccu

SEQ ID NO: 4004 - RNA, 22 nt, Artificial Sequence
  Guide Sequence
gcgucaugcccagccacuucag

SEQ ID NO: 4005 - RNA, 22 nt, Artificial Sequence
  Guide Sequence
gcugaggcuccaagaguguggc

SEQ ID NO: 4006 - RNA, 22 nt, Artificial Sequence
  Guide Sequence
ggagccucagcugaaguggcug

SEQ ID NO: 4007 - RNA, 22 nt, Artificial Sequence
  Guide Sequence
ggccacacucuuggagccucag

SEQ ID NO: 4008 - RNA, 22 nt, Artificial Sequence
  Guide Sequence
ggcgggccacacucuuggagcc

SEQ ID NO: 4009 - RNA, 22 nt, Artificial Sequence
  Guide Sequence
ggcgucaugcccagccacuuca

SEQ ID NO: 4010 - RNA, 22 nt, Artificial Sequence
  Guide Sequence
gggccacacucuuggagccuca

SEQ ID NO: 4011 - RNA, 22 nt, Artificial Sequence
  Guide Sequence
gucaugcccagccacuucagcu

SEQ ID NO: 4012 - RNA, 22 nt, Artificial Sequence
  Guide Sequence
ucagcugaaguggcugggcaug

SEQ ID NO: 4013 - RNA, 22 nt, Artificial Sequence
  Guide Sequence
ucagcugaggcuccaagagugu

SEQ ID NO: 4014 - RNA, 22 nt, Artificial Sequence
  Guide Sequence
ucaugcccagccacuucagcug

SEQ ID NO: 4015 - RNA, 22 nt, Artificial Sequence
  Guide Sequence
ucuuggagccucagcugaagug

SEQ ID NO: 4016 - RNA, 22 nt, Artificial Sequence
  Guide Sequence
ugcccagccacuucagcugagg

SEQ ID NO: 4017 - RNA, 22 nt, Artificial Sequence
  Guide Sequence
uggagccucagcugaaguggcu

SEQ ID NO: 4018 - RNA, 22 nt, Artificial Sequence
  Guide Sequence
uucagcugaggcuccaagagug

SEQ ID NO: 4019 - RNA, 22 nt, Artificial Sequence
  Guide Sequence
uuggagccucagcugaaguggc

SEQ ID NO: 4020 - RNA, 20 nt, Artificial Sequence
  Guide Sequence
acacucuuggagccucucgg

SEQ ID NO: 4021 - RNA, 20 nt, Artificial Sequence
  Guide Sequence
acucuuggagccucucggcu

SEQ ID NO: 4022 - RNA, 20 nt, Artificial Sequence
  Guide Sequence
acuucagccgagaggcucca

SEQ ID NO: 4023 - RNA, 20 nt, Artificial Sequence
  Guide Sequence
agaggcuccaagaguguggc

SEQ ID NO: 4024 - RNA, 20 nt, Artificial Sequence
  Guide Sequence
agccacuucagccgagaggc

SEQ ID NO: 4025 - RNA, 20 nt, Artificial Sequence
  Guide Sequence
agccgagaggcuccaagagu

SEQ ID NO: 4026 - RNA, 20 nt, Artificial Sequence
  Guide Sequence
agccucucggcugaaguggc

SEQ ID NO: 4027 - RNA, 20 nt, Artificial Sequence
  Guide Sequence
augcccagccacuucagccg

SEQ ID NO: 4028 - RNA, 20 nt, Artificial Sequence
  Guide Sequence
cacacucuuggagccucucg

SEQ ID NO: 4029 - RNA, 20 nt, Artificial Sequence
  Guide Sequence
cacucuuggagccucucggc

SEQ ID NO: 4030 - RNA, 20 nt, Artificial Sequence
  Guide Sequence
cacuucagccgagaggcucc

SEQ ID NO: 4031 - RNA, 20 nt, Artificial Sequence
  Guide Sequence
cagccacuucagccgagagg

SEQ ID NO: 4032 - RNA, 20 nt, Artificial Sequence
  Guide Sequence
cagccgagaggcuccaagag

SEQ ID NO: 4033 - RNA, 20 nt, Artificial Sequence
  Guide Sequence
caugcccagccacuucagcc

SEQ ID NO: 4034 - RNA, 20 nt, Artificial Sequence
  Guide Sequence
ccacacucuuggagccucuc

SEQ ID NO: 4035 - RNA, 20 nt, Artificial Sequence
  Guide Sequence
ccacuucagccgagaggcuc

SEQ ID NO: 4036 - RNA, 20 nt, Artificial Sequence
  Guide Sequence
ccagccacuucagccgagag

SEQ ID NO: 4037 - RNA, 20 nt, Artificial Sequence
  Guide Sequence
cccagccacuucagccgaga

SEQ ID NO: 4038 - RNA, 20 nt, Artificial Sequence
  Guide Sequence
cccggcgggccacacucuug

SEQ ID NO: 4039 - RNA, 20 nt, Artificial Sequence
  Guide Sequence
ccgagaggcuccaagagugu

SEQ ID NO: 4040 - RNA, 20 nt, Artificial Sequence
  Guide Sequence
ccggcgggccacacucuugg

SEQ ID NO: 4041 - RNA, 20 nt, Artificial Sequence
  Guide Sequence
ccucucggcugaaguggcug

SEQ ID NO: 4042 - RNA, 20 nt, Artificial Sequence
  Guide Sequence
cgagaggcuccaagagugug

SEQ ID NO: 4043 - RNA, 20 nt, Artificial Sequence
  Guide Sequence
cggcgggccacacucuugga

SEQ ID NO: 4044 - RNA, 20 nt, Artificial Sequence
  Guide Sequence
cucucggcugaaguggcugg

SEQ ID NO: 4045 - RNA, 20 nt, Artificial Sequence
  Guide Sequence
cucuuggagccucucggcug

SEQ ID NO: 4046 - RNA, 20 nt, Artificial Sequence
  Guide Sequence
cuucagccgagaggcuccaa

SEQ ID NO: 4047 - RNA, 20 nt, Artificial Sequence
  Guide Sequence
cuuggagccucucggcugaa

SEQ ID NO: 4048 - RNA, 20 nt, Artificial Sequence
  Guide Sequence
gagaggcuccaagagugugg

SEQ ID NO: 4049 - RNA, 20 nt, Artificial Sequence
  Guide Sequence
gagccucucggcugaagugg

SEQ ID NO: 4050 - RNA, 20 nt, Artificial Sequence
  Guide Sequence
gaggcuccaagaguguggcc

SEQ ID NO: 4051 - RNA, 20 nt, Artificial Sequence
  Guide Sequence
gccacacucuuggagccucu

SEQ ID NO: 4052 - RNA, 20 nt, Artificial Sequence
  Guide Sequence
gccacuucagccgagaggcu

SEQ ID NO: 4053 - RNA, 20 nt, Artificial Sequence
  Guide Sequence
gcccagccacuucagccgag

SEQ ID NO: 4054 - RNA, 20 nt, Artificial Sequence
  Guide Sequence
gccgagaggcuccaagagug

SEQ ID NO: 4055 - RNA, 20 nt, Artificial Sequence
  Guide Sequence
gccucucggcugaaguggcu

SEQ ID NO: 4056 - RNA, 20 nt, Artificial Sequence
  Guide Sequence
gcuccaagaguguggcccgc

SEQ ID NO: 4057 - RNA, 20 nt, Artificial Sequence
  Guide Sequence
ggagccucucggcugaagug

SEQ ID NO: 4058 - RNA, 20 nt, Artificial Sequence
  Guide Sequence
ggcgggccacacucuuggag

SEQ ID NO: 4059 - RNA, 20 nt, Artificial Sequence
  Guide Sequence
ggcuccaagaguguggcccg

SEQ ID NO: 4060 - RNA, 20 nt, Artificial Sequence
  Guide Sequence
ucagccgagaggcuccaaga

SEQ ID NO: 4061 - RNA, 20 nt, Artificial Sequence
  Guide Sequence
ucuuggagccucucggcuga

SEQ ID NO: 4062 - RNA, 20 nt, Artificial Sequence
  Guide Sequence
ugcccagccacuucagccga

SEQ ID NO: 4063 - RNA, 20 nt, Artificial Sequence
  Guide Sequence
uggagccucucggcugaagu

SEQ ID NO: 4064 - RNA, 20 nt, Artificial Sequence
  Guide Sequence
uucagccgagaggcuccaag

SEQ ID NO: 4065 - RNA, 20 nt, Artificial Sequence
  Guide Sequence
uuggagccucucggcugaag

SEQ ID NO: 4066 - RNA, 21 nt, Artificial Sequence
  Guide Sequence
acacucuuggagccucucggc

SEQ ID NO: 4067 - RNA, 21 nt, Artificial Sequence
  Guide Sequence
acccggcgggccacacucuug

SEQ ID NO: 4068 - RNA, 21 nt, Artificial Sequence
  Guide Sequence
acucuuggagccucucggcug

SEQ ID NO: 4069 - RNA, 21 nt, Artificial Sequence
  Guide Sequence
acuucagccgagaggcuccaa

SEQ ID NO: 4070 - RNA, 21 nt, Artificial Sequence
  Guide Sequence
agaggcuccaagaguguggcc

SEQ ID NO: 4071 - RNA, 21 nt, Artificial Sequence
  Guide Sequence
agccacuucagccgagaggcu

SEQ ID NO: 4072 - RNA, 21 nt, Artificial Sequence
  Guide Sequence
agccgagaggcuccaagagug

SEQ ID NO: 4073 - RNA, 21 nt, Artificial Sequence
  Guide Sequence
agccucucggcugaaguggcu

SEQ ID NO: 4074 - RNA, 21 nt, Artificial Sequence
  Guide Sequence
augcccagccacuucagccga

SEQ ID NO: 4075 - RNA, 21 nt, Artificial Sequence
  Guide Sequence
cacacucuuggagccucucgg

SEQ ID NO: 4076 - RNA, 21 nt, Artificial Sequence
  Guide Sequence
cacucuuggagccucucggcu

SEQ ID NO: 4077 - RNA, 21 nt, Artificial Sequence
  Guide Sequence
cacuucagccgagaggcucca

SEQ ID NO: 4078 - RNA, 21 nt, Artificial Sequence
  Guide Sequence
cagccacuucagccgagaggc

SEQ ID NO: 4079 - RNA, 21 nt, Artificial Sequence
  Guide Sequence
cagccgagaggcuccaagagu

SEQ ID NO: 4080 - RNA, 21 nt, Artificial Sequence
  Guide Sequence
caugcccagccacuucagccg

SEQ ID NO: 4081 - RNA, 21 nt, Artificial Sequence
  Guide Sequence
ccacacucuuggagccucucg

SEQ ID NO: 4082 - RNA, 21 nt, Artificial Sequence
  Guide Sequence
ccacuucagccgagaggcucc

SEQ ID NO: 4083 - RNA, 21 nt, Artificial Sequence
  Guide Sequence
ccagccacuucagccgagagg

SEQ ID NO: 4084 - RNA, 21 nt, Artificial Sequence
  Guide Sequence
cccagccacuucagccgagag

SEQ ID NO: 4085 - RNA, 21 nt, Artificial Sequence
  Guide Sequence
cccggcgggccacacucuugg

SEQ ID NO: 4086 - RNA, 21 nt, Artificial Sequence
  Guide Sequence
ccgagaggcuccaagagugug

SEQ ID NO: 4087 - RNA, 21 nt, Artificial Sequence
  Guide Sequence
ccggcgggccacacucuugga

SEQ ID NO: 4088 - RNA, 21 nt, Artificial Sequence
  Guide Sequence
ccucucggcugaaguggcugg

SEQ ID NO: 4089 - RNA, 21 nt, Artificial Sequence
  Guide Sequence
cgagaggcuccaagagugugg

SEQ ID NO: 4090 - RNA, 21 nt, Artificial Sequence
  Guide Sequence
cggcgggccacacucuuggag

SEQ ID NO: 4091 - RNA, 21 nt, Artificial Sequence
  Guide Sequence
cucucggcugaaguggcuggg

SEQ ID NO: 4092 - RNA, 21 nt, Artificial Sequence
  Guide Sequence
cucuuggagccucucggcuga

SEQ ID NO: 4093 - RNA, 21 nt, Artificial Sequence
  Guide Sequence
cuucagccgagaggcuccaag

SEQ ID NO: 4094 - RNA, 21 nt, Artificial Sequence
  Guide Sequence
cuuggagccucucggcugaag

SEQ ID NO: 4095 - RNA, 21 nt, Artificial Sequence
  Guide Sequence
gagaggcuccaagaguguggc

SEQ ID NO: 4096 - RNA, 21 nt, Artificial Sequence
  Guide Sequence
gagccucucggcugaaguggc

SEQ ID NO: 4097 - RNA, 21 nt, Artificial Sequence
  Guide Sequence
gaggcuccaagaguguggccc

SEQ ID NO: 4098 - RNA, 21 nt, Artificial Sequence
  Guide Sequence
gccacacucuuggagccucuc

SEQ ID NO: 4099 - RNA, 21 nt, Artificial Sequence
  Guide Sequence
gccacuucagccgagaggcuc

SEQ ID NO: 4100 - RNA, 21 nt, Artificial Sequence
  Guide Sequence
gcccagccacuucagccgaga

SEQ ID NO: 4101 - RNA, 21 nt, Artificial Sequence
  Guide Sequence
gccgagaggcuccaagagugu

SEQ ID NO: 4102 - RNA, 21 nt, Artificial Sequence
  Guide Sequence
gccucucggcugaaguggcug

SEQ ID NO: 4103 - RNA, 21 nt, Artificial Sequence
  Guide Sequence
gcuccaagaguguggcccgcc

SEQ ID NO: 4104 - RNA, 21 nt, Artificial Sequence
  Guide Sequence
ggagccucucggcugaagugg

SEQ ID NO: 4105 - RNA, 21 nt, Artificial Sequence
  Guide Sequence
ggccacacucuuggagccucu

SEQ ID NO: 4106 - RNA, 21 nt, Artificial Sequence
  Guide Sequence
ggcuccaagaguguggcccgc

SEQ ID NO: 4107 - RNA, 21 nt, Artificial Sequence
  Guide Sequence
ucagccgagaggcuccaagag

SEQ ID NO: 4108 - RNA, 21 nt, Artificial Sequence
  Guide Sequence
ucaugcccagccacuucagcc

SEQ ID NO: 4109 - RNA, 21 nt, Artificial Sequence
  Guide Sequence
ucuuggagccucucggcugaa

SEQ ID NO: 4110 - RNA, 21 nt, Artificial Sequence
  Guide Sequence
ugcccagccacuucagccgag

SEQ ID NO: 4111 - RNA, 21 nt, Artificial Sequence
  Guide Sequence
uggagccucucggcugaagug

SEQ ID NO: 4112 - RNA, 21 nt, Artificial Sequence
  Guide Sequence
uucagccgagaggcuccaaga

SEQ ID NO: 4113 - RNA, 21 nt, Artificial Sequence
  Guide Sequence
uuggagccucucggcugaagu

SEQ ID NO: 4114 - RNA, 22 nt, Artificial Sequence
  Guide Sequence
acacucuuggagccucucggcu

SEQ ID NO: 4115 - RNA, 22 nt, Artificial Sequence
  Guide Sequence
acccggcgggccacacucuugg

SEQ ID NO: 4116 - RNA, 22 nt, Artificial Sequence
  Guide Sequence
acucuuggagccucucggcuga

SEQ ID NO: 4117 - RNA, 22 nt, Artificial Sequence
  Guide Sequence
acuucagccgagaggcuccaag

SEQ ID NO: 4118 - RNA, 22 nt, Artificial Sequence
  Guide Sequence
agaggcuccaagaguguggccc

SEQ ID NO: 4119 - RNA, 22 nt, Artificial Sequence
  Guide Sequence
agccacuucagccgagaggcuc

SEQ ID NO: 4120 - RNA, 22 nt, Artificial Sequence
  Guide Sequence
agccgagaggcuccaagagugu

SEQ ID NO: 4121 - RNA, 22 nt, Artificial Sequence
  Guide Sequence
agccucucggcugaaguggcug

SEQ ID NO: 4122 - RNA, 22 nt, Artificial Sequence
  Guide Sequence
augcccagccacuucagccgag

SEQ ID NO: 4123 - RNA, 22 nt, Artificial Sequence
  Guide Sequence
cacacucuuggagccucucggc

SEQ ID NO: 4124 - RNA, 22 nt, Artificial Sequence
  Guide Sequence
cacucuuggagccucucggcug

SEQ ID NO: 4125 - RNA, 22 nt, Artificial Sequence
  Guide Sequence
cacuucagccgagaggcuccaa

SEQ ID NO: 4126 - RNA, 22 nt, Artificial Sequence
  Guide Sequence
cagccacuucagccgagaggcu

SEQ ID NO: 4127 - RNA, 22 nt, Artificial Sequence
  Guide Sequence
cagccgagaggcuccaagagug

SEQ ID NO: 4128 - RNA, 22 nt, Artificial Sequence
  Guide Sequence
caugcccagccacuucagccga

SEQ ID NO: 4129 - RNA, 22 nt, Artificial Sequence
  Guide Sequence
ccacacucuuggagccucucgg

SEQ ID NO: 4130 - RNA, 22 nt, Artificial Sequence
  Guide Sequence
ccacuucagccgagaggcucca

SEQ ID NO: 4131 - RNA, 22 nt, Artificial Sequence
  Guide Sequence
ccagccacuucagccgagaggc

SEQ ID NO: 4132 - RNA, 22 nt, Artificial Sequence
  Guide Sequence
cccagccacuucagccgagagg

SEQ ID NO: 4133 - RNA, 22 nt, Artificial Sequence
  Guide Sequence
cccggcgggccacacucuugga

SEQ ID NO: 4134 - RNA, 22 nt, Artificial Sequence
  Guide Sequence
ccgagaggcuccaagagugugg

SEQ ID NO: 4135 - RNA, 22 nt, Artificial Sequence
  Guide Sequence
ccggcgggccacacucuuggag

SEQ ID NO: 4136 - RNA, 22 nt, Artificial Sequence
  Guide Sequence
ccucucggcugaaguggcuggg

SEQ ID NO: 4137 - RNA, 22 nt, Artificial Sequence
  Guide Sequence
cgagaggcuccaagaguguggc

SEQ ID NO: 4138 - RNA, 22 nt, Artificial Sequence
  Guide Sequence
cucucggcugaaguggcugggc

SEQ ID NO: 4139 - RNA, 22 nt, Artificial Sequence
  Guide Sequence
cucuuggagccucucggcugaa

SEQ ID NO: 4140 - RNA, 22 nt, Artificial Sequence
  Guide Sequence
cuucagccgagaggcuccaaga

SEQ ID NO: 4141 - RNA, 22 nt, Artificial Sequence
  Guide Sequence
cuuggagccucucggcugaagu

SEQ ID NO: 4142 - RNA, 22 nt, Artificial Sequence
  Guide Sequence
gacccggcgggccacacucuug

SEQ ID NO: 4143 - RNA, 22 nt, Artificial Sequence
  Guide Sequence
gagaggcuccaagaguguggcc

SEQ ID NO: 4144 - RNA, 22 nt, Artificial Sequence
  Guide Sequence
gagccucucggcugaaguggcu

SEQ ID NO: 4145 - RNA, 22 nt, Artificial Sequence
  Guide Sequence
gaggcuccaagaguguggcccg

SEQ ID NO: 4146 - RNA, 22 nt, Artificial Sequence
  Guide Sequence
gccacacucuuggagccucucg

SEQ ID NO: 4147 - RNA, 22 nt, Artificial Sequence
  Guide Sequence
gccacuucagccgagaggcucc

SEQ ID NO: 4148 - RNA, 22 nt, Artificial Sequence
  Guide Sequence
gcccagccacuucagccgagag

SEQ ID NO: 4149 - RNA, 22 nt, Artificial Sequence
  Guide Sequence
gccgagaggcuccaagagugug

SEQ ID NO: 4150 - RNA, 22 nt, Artificial Sequence
  Guide Sequence
gccucucggcugaaguggcugg

SEQ ID NO: 4151 - RNA, 22 nt, Artificial Sequence
  Guide Sequence
gcuccaagaguguggcccgccg

SEQ ID NO: 4152 - RNA, 22 nt, Artificial Sequence
  Guide Sequence
ggagccucucggcugaaguggc

SEQ ID NO: 4153 - RNA, 22 nt, Artificial Sequence
  Guide Sequence
ggccacacucuuggagccucuc

SEQ ID NO: 4154 - RNA, 22 nt, Artificial Sequence
  Guide Sequence
ggcuccaagaguguggcccgcc

SEQ ID NO: 4155 - RNA, 22 nt, Artificial Sequence
  Guide Sequence
gggccacacucuuggagccucu

SEQ ID NO: 4156 - RNA, 22 nt, Artificial Sequence
  Guide Sequence
gucaugcccagccacuucagcc

SEQ ID NO: 4157 - RNA, 22 nt, Artificial Sequence
  Guide Sequence
ucagccgagaggcuccaagagu

SEQ ID NO: 4158 - RNA, 22 nt, Artificial Sequence
  Guide Sequence
ucaugcccagccacuucagccg

SEQ ID NO: 4159 - RNA, 22 nt, Artificial Sequence
  Guide Sequence
ucuuggagccucucggcugaag

SEQ ID NO: 4160 - RNA, 22 nt, Artificial Sequence
  Guide Sequence
ugcccagccacuucagccgaga

SEQ ID NO: 4161 - RNA, 22 nt, Artificial Sequence
  Guide Sequence
uggagccucucggcugaagugg

SEQ ID NO: 4162 - RNA, 22 nt, Artificial Sequence
  Guide Sequence
uucagccgagaggcuccaagag

SEQ ID NO: 4163 - RNA, 22 nt, Artificial Sequence
  Guide Sequence
uuggagccucucggcugaagug

SEQ ID NO: 4164 - RNA, 20 nt, Artificial Sequence
  Guide Sequence
aagaguguguguguggcccg

SEQ ID NO: 4165 - RNA, 20 nt, Artificial Sequence
  Guide Sequence
acacacacacucuuggagcc

SEQ ID NO: 4166 - RNA, 20 nt, Artificial Sequence
  Guide Sequence
acacacacucuuggagccuc

SEQ ID NO: 4167 - RNA, 20 nt, Artificial Sequence
  Guide Sequence
acacacucuuggagccucgg

SEQ ID NO: 4168 - RNA, 20 nt, Artificial Sequence
  Guide Sequence
acacucuuggagccucggcu

SEQ ID NO: 4169 - RNA, 20 nt, Artificial Sequence
  Guide Sequence
acccggcgggccacacacac

SEQ ID NO: 4170 - RNA, 20 nt, Artificial Sequence
  Guide Sequence
acuucagccgaggcuccaag

SEQ ID NO: 4171 - RNA, 20 nt, Artificial Sequence
  Guide Sequence
agaguguguguguggcccgc

SEQ ID NO: 4172 - RNA, 20 nt, Artificial Sequence
  Guide Sequence
agccgaggcuccaagagugu

SEQ ID NO: 4173 - RNA, 20 nt, Artificial Sequence
  Guide Sequence
aggacccggcgggccacaca

SEQ ID NO: 4174 - RNA, 20 nt, Artificial Sequence
  Guide Sequence
aggcuccaagagugugugug

SEQ ID NO: 4175 - RNA, 20 nt, Artificial Sequence
  Guide Sequence
aguguguguguggcccgccg

SEQ ID NO: 4176 - RNA, 20 nt, Artificial Sequence
  Guide Sequence
caagaguguguguguggccc

SEQ ID NO: 4177 - RNA, 20 nt, Artificial Sequence
  Guide Sequence
cacacacacacucuuggagc

SEQ ID NO: 4178 - RNA, 20 nt, Artificial Sequence
  Guide Sequence
cacacacacucuuggagccu

SEQ ID NO: 4179 - RNA, 20 nt, Artificial Sequence
  Guide Sequence
cacacacucuuggagccucg

SEQ ID NO: 4180 - RNA, 20 nt, Artificial Sequence
  Guide Sequence
cacacucuuggagccucggc

SEQ ID NO: 4181 - RNA, 20 nt, Artificial Sequence
  Guide Sequence
cagccgaggcuccaagagug

SEQ ID NO: 4182 - RNA, 20 nt, Artificial Sequence
  Guide Sequence
ccaagaguguguguguggcc

SEQ ID NO: 4183 - RNA, 20 nt, Artificial Sequence
  Guide Sequence
ccacacacacacucuuggag

SEQ ID NO: 4184 - RNA, 20 nt, Artificial Sequence
  Guide Sequence
cccggcgggccacacacaca

SEQ ID NO: 4185 - RNA, 20 nt, Artificial Sequence
  Guide Sequence
ccgaggcuccaagagugugu

SEQ ID NO: 4186 - RNA, 20 nt, Artificial Sequence
  Guide Sequence
ccggcgggccacacacacac

SEQ ID NO: 4187 - RNA, 20 nt, Artificial Sequence
  Guide Sequence
cgaggcuccaagagugugug

SEQ ID NO: 4188 - RNA, 20 nt, Artificial Sequence
  Guide Sequence
cggcgggccacacacacacu

SEQ ID NO: 4189 - RNA, 20 nt, Artificial Sequence
  Guide Sequence
cgggccacacacacacucuu

SEQ ID NO: 4190 - RNA, 20 nt, Artificial Sequence
  Guide Sequence
cuccaagagugugugugugg

SEQ ID NO: 4191 - RNA, 20 nt, Artificial Sequence
  Guide Sequence
cuucagccgaggcuccaaga

SEQ ID NO: 4192 - RNA, 20 nt, Artificial Sequence
  Guide Sequence
gacccggcgggccacacaca

SEQ ID NO: 4193 - RNA, 20 nt, Artificial Sequence
  Guide Sequence
gaggacccggcgggccacac

SEQ ID NO: 4194 - RNA, 20 nt, Artificial Sequence
  Guide Sequence
gaggcuccaagagugugugu

SEQ ID NO: 4195 - RNA, 20 nt, Artificial Sequence
  Guide Sequence
gaguguguguguggcccgcc

SEQ ID NO: 4196 - RNA, 20 nt, Artificial Sequence
  Guide Sequence
gccacacacacacucuugga

SEQ ID NO: 4197 - RNA, 20 nt, Artificial Sequence
  Guide Sequence
gccgaggcuccaagagugug

SEQ ID NO: 4198 - RNA, 20 nt, Artificial Sequence
  Guide Sequence
gcgggccacacacacacucu

SEQ ID NO: 4199 - RNA, 20 nt, Artificial Sequence
  Guide Sequence
gcuccaagagugugugugug

SEQ ID NO: 4200 - RNA, 20 nt, Artificial Sequence
  Guide Sequence
ggacccggcgggccacacac

SEQ ID NO: 4201 - RNA, 20 nt, Artificial Sequence
  Guide Sequence
ggaggacccggcgggccaca

SEQ ID NO: 4202 - RNA, 20 nt, Artificial Sequence
  Guide Sequence
ggccacacacacacucuugg

SEQ ID NO: 4203 - RNA, 20 nt, Artificial Sequence
  Guide Sequence
ggcgggccacacacacacuc

SEQ ID NO: 4204 - RNA, 20 nt, Artificial Sequence
  Guide Sequence
ggcuccaagagugugugugu

SEQ ID NO: 4205 - RNA, 20 nt, Artificial Sequence
  Guide Sequence
gggccacacacacacucuug

SEQ ID NO: 4206 - RNA, 20 nt, Artificial Sequence
  Guide Sequence
guguguggcccgccgggucc

SEQ ID NO: 4207 - RNA, 20 nt, Artificial Sequence
  Guide Sequence
guguguguguggcccgccgg

SEQ ID NO: 4208 - RNA, 20 nt, Artificial Sequence
  Guide Sequence
ucagccgaggcuccaagagu

SEQ ID NO: 4209 - RNA, 20 nt, Artificial Sequence
  Guide Sequence
uccaagaguguguguguggc

SEQ ID NO: 4210 - RNA, 20 nt, Artificial Sequence
  Guide Sequence
uggaggacccggcgggccac

SEQ ID NO: 4211 - RNA, 20 nt, Artificial Sequence
  Guide Sequence
uguguguggcccgccggguc

SEQ ID NO: 4212 - RNA, 20 nt, Artificial Sequence
  Guide Sequence
uguguguguggcccgccggg

SEQ ID NO: 4213 - RNA, 20 nt, Artificial Sequence
  Guide Sequence
uucagccgaggcuccaagag

SEQ ID NO: 4214 - RNA, 21 nt, Artificial Sequence
  Guide Sequence
aagaguguguguguggcccgc

SEQ ID NO: 4215 - RNA, 21 nt, Artificial Sequence
  Guide Sequence
acacacacacucuuggagccu

SEQ ID NO: 4216 - RNA, 21 nt, Artificial Sequence
  Guide Sequence
acacacacucuuggagccucg

SEQ ID NO: 4217 - RNA, 21 nt, Artificial Sequence
  Guide Sequence
acacacucuuggagccucggc

SEQ ID NO: 4218 - RNA, 21 nt, Artificial Sequence
  Guide Sequence
acacucuuggagccucggcug

SEQ ID NO: 4219 - RNA, 21 nt, Artificial Sequence
  Guide Sequence
acccggcgggccacacacaca

SEQ ID NO: 4220 - RNA, 21 nt, Artificial Sequence
  Guide Sequence
acuucagccgaggcuccaaga

SEQ ID NO: 4221 - RNA, 21 nt, Artificial Sequence
  Guide Sequence
agaguguguguguggcccgcc

SEQ ID NO: 4222 - RNA, 21 nt, Artificial Sequence
  Guide Sequence
agccgaggcuccaagagugug

SEQ ID NO: 4223 - RNA, 21 nt, Artificial Sequence
  Guide Sequence
aggacccggcgggccacacac

SEQ ID NO: 4224 - RNA, 21 nt, Artificial Sequence
  Guide Sequence
aggcuccaagagugugugugu

SEQ ID NO: 4225 - RNA, 21 nt, Artificial Sequence
  Guide Sequence
aguguguguguggcccgccgg

SEQ ID NO: 4226 - RNA, 21 nt, Artificial Sequence
  Guide Sequence
caagaguguguguguggcccg

SEQ ID NO: 4227 - RNA, 21 nt, Artificial Sequence
  Guide Sequence
cacacacacacucuuggagcc

SEQ ID NO: 4228 - RNA, 21 nt, Artificial Sequence
  Guide Sequence
cacacacacucuuggagccuc

SEQ ID NO: 4229 - RNA, 21 nt, Artificial Sequence
  Guide Sequence
cacacacucuuggagccucgg

SEQ ID NO: 4230 - RNA, 21 nt, Artificial Sequence
  Guide Sequence
cacacucuuggagccucggcu

SEQ ID NO: 4231 - RNA, 21 nt, Artificial Sequence
  Guide Sequence
cacuucagccgaggcuccaag

SEQ ID NO: 4232 - RNA, 21 nt, Artificial Sequence
  Guide Sequence
cagccgaggcuccaagagugu

SEQ ID NO: 4233 - RNA, 21 nt, Artificial Sequence
  Guide Sequence
ccaagaguguguguguggccc

SEQ ID NO: 4234 - RNA, 21 nt, Artificial Sequence
  Guide Sequence
ccacacacacacucuuggagc

SEQ ID NO: 4235 - RNA, 21 nt, Artificial Sequence
  Guide Sequence
cccggcgggccacacacacac

SEQ ID NO: 4236 - RNA, 21 nt, Artificial Sequence
  Guide Sequence
ccgaggcuccaagagugugug

SEQ ID NO: 4237 - RNA, 21 nt, Artificial Sequence
  Guide Sequence
ccggcgggccacacacacacu

SEQ ID NO: 4238 - RNA, 21 nt, Artificial Sequence
  Guide Sequence
cgaggcuccaagagugugugu

SEQ ID NO: 4239 - RNA, 21 nt, Artificial Sequence
  Guide Sequence
cggcgggccacacacacacuc

SEQ ID NO: 4240 - RNA, 21 nt, Artificial Sequence
  Guide Sequence
cgggccacacacacacucuug

SEQ ID NO: 4241 - RNA, 21 nt, Artificial Sequence
  Guide Sequence
cuccaagaguguguguguggc

SEQ ID NO: 4242 - RNA, 21 nt, Artificial Sequence
  Guide Sequence
cuucagccgaggcuccaagag

SEQ ID NO: 4243 - RNA, 21 nt, Artificial Sequence
  Guide Sequence
gacccggcgggccacacacac

SEQ ID NO: 4244 - RNA, 21 nt, Artificial Sequence
  Guide Sequence
gaggacccggcgggccacaca

SEQ ID NO: 4245 - RNA, 21 nt, Artificial Sequence
  Guide Sequence
gaggcuccaagagugugugug

SEQ ID NO: 4246 - RNA, 21 nt, Artificial Sequence
  Guide Sequence
gaguguguguguggcccgccg

SEQ ID NO: 4247 - RNA, 21 nt, Artificial Sequence
  Guide Sequence
gccacacacacacucuuggag

SEQ ID NO: 4248 - RNA, 21 nt, Artificial Sequence
  Guide Sequence
gccgaggcuccaagagugugu

SEQ ID NO: 4249 - RNA, 21 nt, Artificial Sequence
  Guide Sequence
gcgggccacacacacacucuu

SEQ ID NO: 4250 - RNA, 21 nt, Artificial Sequence
  Guide Sequence
gcuccaagagugugugugugg

SEQ ID NO: 4251 - RNA, 21 nt, Artificial Sequence
  Guide Sequence
ggacccggcgggccacacaca

SEQ ID NO: 4252 - RNA, 21 nt, Artificial Sequence
  Guide Sequence
ggccacacacacacucuugga

SEQ ID NO: 4253 - RNA, 21 nt, Artificial Sequence
  Guide Sequence
ggcgggccacacacacacucu

SEQ ID NO: 4254 - RNA, 21 nt, Artificial Sequence
  Guide Sequence
ggcuccaagagugugugugug

SEQ ID NO: 4255 - RNA, 21 nt, Artificial Sequence
  Guide Sequence
gggccacacacacacucuugg

SEQ ID NO: 4256 - RNA, 21 nt, Artificial Sequence
  Guide Sequence
guguguggcccgccggguccu

SEQ ID NO: 4257 - RNA, 21 nt, Artificial Sequence
  Guide Sequence
guguguguguggcccgccggg

SEQ ID NO: 4258 - RNA, 21 nt, Artificial Sequence
  Guide Sequence
ucagccgaggcuccaagagug

SEQ ID NO: 4259 - RNA, 21 nt, Artificial Sequence
  Guide Sequence
uccaagaguguguguguggcc

SEQ ID NO: 4260 - RNA, 21 nt, Artificial Sequence
  Guide Sequence
uggaggacccggcgggccaca

SEQ ID NO: 4261 - RNA, 21 nt, Artificial Sequence
  Guide Sequence
uguguguggcccgccgggucc

SEQ ID NO: 4262 - RNA, 21 nt, Artificial Sequence
  Guide Sequence
uguguguguggcccgccgggu

SEQ ID NO: 4263 - RNA, 21 nt, Artificial Sequence
  Guide Sequence
uucagccgaggcuccaagagu

SEQ ID NO: 4264 - RNA, 21 nt, Artificial Sequence
  Guide Sequence
uuggaggacccggcgggccac

SEQ ID NO: 4265 - RNA, 22 nt, Artificial Sequence
  Guide Sequence
aagaguguguguguggcccgcc

SEQ ID NO: 4266 - RNA, 22 nt, Artificial Sequence
  Guide Sequence
acacacacacucuuggagccuc

SEQ ID NO: 4267 - RNA, 22 nt, Artificial Sequence
  Guide Sequence
acacacacucuuggagccucgg

SEQ ID NO: 4268 - RNA, 22 nt, Artificial Sequence
  Guide Sequence
acacacucuuggagccucggcu

SEQ ID NO: 4269 - RNA, 22 nt, Artificial Sequence
  Guide Sequence
acacucuuggagccucggcuga

SEQ ID NO: 4270 - RNA, 22 nt, Artificial Sequence
  Guide Sequence
acccggcgggccacacacacac

SEQ ID NO: 4271 - RNA, 22 nt, Artificial Sequence
  Guide Sequence
acuucagccgaggcuccaagag

SEQ ID NO: 4272 - RNA, 22 nt, Artificial Sequence
  Guide Sequence
agaguguguguguggcccgccg

SEQ ID NO: 4273 - RNA, 22 nt, Artificial Sequence
  Guide Sequence
agccgaggcuccaagagugugu

SEQ ID NO: 4274 - RNA, 22 nt, Artificial Sequence
  Guide Sequence
aggacccggcgggccacacaca

SEQ ID NO: 4275 - RNA, 22 nt, Artificial Sequence
  Guide Sequence
aggcuccaagagugugugugug

SEQ ID NO: 4276 - RNA, 22 nt, Artificial Sequence
  Guide Sequence
aguguguguguggcccgccggg

SEQ ID NO: 4277 - RNA, 22 nt, Artificial Sequence
  Guide Sequence
caagaguguguguguggcccgc

SEQ ID NO: 4278 - RNA, 22 nt, Artificial Sequence
  Guide Sequence
cacacacacacucuuggagccu

SEQ ID NO: 4279 - RNA, 22 nt, Artificial Sequence
  Guide Sequence
cacacacacucuuggagccucg

SEQ ID NO: 4280 - RNA, 22 nt, Artificial Sequence
  Guide Sequence
cacacacucuuggagccucggc

SEQ ID NO: 4281 - RNA, 22 nt, Artificial Sequence
  Guide Sequence
cacacucuuggagccucggcug

SEQ ID NO: 4282 - RNA, 22 nt, Artificial Sequence
  Guide Sequence
cacuucagccgaggcuccaaga

SEQ ID NO: 4283 - RNA, 22 nt, Artificial Sequence
  Guide Sequence
cagccgaggcuccaagagugug

SEQ ID NO: 4284 - RNA, 22 nt, Artificial Sequence
  Guide Sequence
ccaagaguguguguguggcccg

SEQ ID NO: 4285 - RNA, 22 nt, Artificial Sequence
  Guide Sequence
ccacacacacacucuuggagcc

SEQ ID NO: 4286 - RNA, 22 nt, Artificial Sequence
  Guide Sequence
ccacuucagccgaggcuccaag

SEQ ID NO: 4287 - RNA, 22 nt, Artificial Sequence
  Guide Sequence
cccggcgggccacacacacacu

SEQ ID NO: 4288 - RNA, 22 nt, Artificial Sequence
  Guide Sequence
ccgaggcuccaagagugugugu

SEQ ID NO: 4289 - RNA, 22 nt, Artificial Sequence
  Guide Sequence
ccggcgggccacacacacacuc

SEQ ID NO: 4290 - RNA, 22 nt, Artificial Sequence
  Guide Sequence
cgaggcuccaagagugugugug

SEQ ID NO: 4291 - RNA, 22 nt, Artificial Sequence
  Guide Sequence
cggcgggccacacacacacucu

SEQ ID NO: 4292 - RNA, 22 nt, Artificial Sequence
  Guide Sequence
cgggccacacacacacucuugg

SEQ ID NO: 4293 - RNA, 22 nt, Artificial Sequence
  Guide Sequence
cuccaagaguguguguguggcc

SEQ ID NO: 4294 - RNA, 22 nt, Artificial Sequence
  Guide Sequence
cuucagccgaggcuccaagagu

SEQ ID NO: 4295 - RNA, 22 nt, Artificial Sequence
  Guide Sequence
cuuggaggacccggcgggccac

SEQ ID NO: 4296 - RNA, 22 nt, Artificial Sequence
  Guide Sequence
gacccggcgggccacacacaca

SEQ ID NO: 4297 - RNA, 22 nt, Artificial Sequence
  Guide Sequence
gaggacccggcgggccacacac

SEQ ID NO: 4298 - RNA, 22 nt, Artificial Sequence
  Guide Sequence
gaggcuccaagagugugugugu

SEQ ID NO: 4299 - RNA, 22 nt, Artificial Sequence
  Guide Sequence
gaguguguguguggcccgccgg

SEQ ID NO: 4300 - RNA, 22 nt, Artificial Sequence
  Guide Sequence
gccacacacacacucuuggagc

SEQ ID NO: 4301 - RNA, 22 nt, Artificial Sequence
  Guide Sequence
gccgaggcuccaagagugugug

SEQ ID NO: 4302 - RNA, 22 nt, Artificial Sequence
  Guide Sequence
gcgggccacacacacacucuug

SEQ ID NO: 4303 - RNA, 22 nt, Artificial Sequence
  Guide Sequence
gcuccaagaguguguguguggc

SEQ ID NO: 4304 - RNA, 22 nt, Artificial Sequence
  Guide Sequence
ggacccggcgggccacacacac

SEQ ID NO: 4305 - RNA, 22 nt, Artificial Sequence
  Guide Sequence
ggaggacccggcgggccacaca

SEQ ID NO: 4306 - RNA, 22 nt, Artificial Sequence
  Guide Sequence
ggccacacacacacucuuggag

SEQ ID NO: 4307 - RNA, 22 nt, Artificial Sequence
  Guide Sequence
ggcgggccacacacacacucuu

SEQ ID NO: 4308 - RNA, 22 nt, Artificial Sequence
  Guide Sequence
ggcuccaagagugugugugugg

SEQ ID NO: 4309 - RNA, 22 nt, Artificial Sequence
  Guide Sequence
gggccacacacacacucuugga

SEQ ID NO: 4310 - RNA, 22 nt, Artificial Sequence
  Guide Sequence
guguguggcccgccggguccuc

SEQ ID NO: 4311 - RNA, 22 nt, Artificial Sequence
  Guide Sequence
guguguguguggcccgccgggu

SEQ ID NO: 4312 - RNA, 22 nt, Artificial Sequence
  Guide Sequence
ucagccgaggcuccaagagugu

SEQ ID NO: 4313 - RNA, 22 nt, Artificial Sequence
  Guide Sequence
uccaagaguguguguguggccc

SEQ ID NO: 4314 - RNA, 22 nt, Artificial Sequence
  Guide Sequence
uggaggacccggcgggccacac

SEQ ID NO: 4315 - RNA, 22 nt, Artificial Sequence
  Guide Sequence
uguguguggcccgccggguccu

SEQ ID NO: 4316 - RNA, 22 nt, Artificial Sequence
  Guide Sequence
uguguguguggcccgccggguc

SEQ ID NO: 4317 - RNA, 22 nt, Artificial Sequence
  Guide Sequence
uucagccgaggcuccaagagug

SEQ ID NO: 4318 - RNA, 22 nt, Artificial Sequence
  Guide Sequence
uuggaggacccggcgggccaca

SEQ ID NO: 4319 - RNA, 20 nt, Artificial Sequence
  Guide Sequence
aacacucuuggagccucggc

SEQ ID NO: 4320 - RNA, 20 nt, Artificial Sequence
  Guide Sequence
aagaguguugggcccgccgg

SEQ ID NO: 4321 - RNA, 20 nt, Artificial Sequence
  Guide Sequence
acccggcgggcccaacacuc

SEQ ID NO: 4322 - RNA, 20 nt, Artificial Sequence
  Guide Sequence
agaguguugggcccgccggg

SEQ ID NO: 4323 - RNA, 20 nt, Artificial Sequence
  Guide Sequence
aggacccggcgggcccaaca

SEQ ID NO: 4324 - RNA, 20 nt, Artificial Sequence
  Guide Sequence
aggcuccaagaguguugggc

SEQ ID NO: 4325 - RNA, 20 nt, Artificial Sequence
  Guide Sequence
aguguugggcccgccggguc

SEQ ID NO: 4326 - RNA, 20 nt, Artificial Sequence
  Guide Sequence
caacacucuuggagccucgg

SEQ ID NO: 4327 - RNA, 20 nt, Artificial Sequence
  Guide Sequence
caagaguguugggcccgccg

SEQ ID NO: 4328 - RNA, 20 nt, Artificial Sequence
  Guide Sequence
ccaacacucuuggagccucg

SEQ ID NO: 4329 - RNA, 20 nt, Artificial Sequence
  Guide Sequence
ccaagaguguugggcccgcc

SEQ ID NO: 4330 - RNA, 20 nt, Artificial Sequence
  Guide Sequence
cccaacacucuuggagccuc

SEQ ID NO: 4331 - RNA, 20 nt, Artificial Sequence
  Guide Sequence
cccggcgggcccaacacucu

SEQ ID NO: 4332 - RNA, 20 nt, Artificial Sequence
  Guide Sequence
ccgaggcuccaagaguguug

SEQ ID NO: 4333 - RNA, 20 nt, Artificial Sequence
  Guide Sequence
ccggcgggcccaacacucuu

SEQ ID NO: 4334 - RNA, 20 nt, Artificial Sequence
  Guide Sequence
cgaggcuccaagaguguugg

SEQ ID NO: 4335 - RNA, 20 nt, Artificial Sequence
  Guide Sequence
cggcgggcccaacacucuug

SEQ ID NO: 4336 - RNA, 20 nt, Artificial Sequence
  Guide Sequence
cgggcccaacacucuuggag

SEQ ID NO: 4337 - RNA, 20 nt, Artificial Sequence
  Guide Sequence
cuccaagaguguugggcccg

SEQ ID NO: 4338 - RNA, 20 nt, Artificial Sequence
  Guide Sequence
cuuggaggacccggcgggcc

SEQ ID NO: 4339 - RNA, 20 nt, Artificial Sequence
  Guide Sequence
gacccggcgggcccaacacu

SEQ ID NO: 4340 - RNA, 20 nt, Artificial Sequence
  Guide Sequence
gaggacccggcgggcccaac

SEQ ID NO: 4341 - RNA, 20 nt, Artificial Sequence
  Guide Sequence
gaggcuccaagaguguuggg

SEQ ID NO: 4342 - RNA, 20 nt, Artificial Sequence
  Guide Sequence
gaguguugggcccgccgggu

SEQ ID NO: 4343 - RNA, 20 nt, Artificial Sequence
  Guide Sequence
gcccaacacucuuggagccu

SEQ ID NO: 4344 - RNA, 20 nt, Artificial Sequence
  Guide Sequence
gccgaggcuccaagaguguu

SEQ ID NO: 4345 - RNA, 20 nt, Artificial Sequence
  Guide Sequence
gcgggcccaacacucuugga

SEQ ID NO: 4346 - RNA, 20 nt, Artificial Sequence
  Guide Sequence
gcuccaagaguguugggccc

SEQ ID NO: 4347 - RNA, 20 nt, Artificial Sequence
  Guide Sequence
gcuuggaggacccggcgggc

SEQ ID NO: 4348 - RNA, 20 nt, Artificial Sequence
  Guide Sequence
ggacccggcgggcccaacac

SEQ ID NO: 4349 - RNA, 20 nt, Artificial Sequence
  Guide Sequence
ggaggacccggcgggcccaa

SEQ ID NO: 4350 - RNA, 20 nt, Artificial Sequence
  Guide Sequence
ggcccaacacucuuggagcc

SEQ ID NO: 4351 - RNA, 20 nt, Artificial Sequence
  Guide Sequence
ggcgggcccaacacucuugg

SEQ ID NO: 4352 - RNA, 20 nt, Artificial Sequence
  Guide Sequence
ggcuccaagaguguugggcc

SEQ ID NO: 4353 - RNA, 20 nt, Artificial Sequence
  Guide Sequence
ggcuuggaggacccggcggg

SEQ ID NO: 4354 - RNA, 20 nt, Artificial Sequence
  Guide Sequence
gggcccaacacucuuggagc

SEQ ID NO: 4355 - RNA, 20 nt, Artificial Sequence
  Guide Sequence
gggcccgccggguccuccaa

SEQ ID NO: 4356 - RNA, 20 nt, Artificial Sequence
  Guide Sequence
gggcuuggaggacccggcgg

SEQ ID NO: 4357 - RNA, 20 nt, Artificial Sequence
  Guide Sequence
guguugggcccgccgggucc

SEQ ID NO: 4358 - RNA, 20 nt, Artificial Sequence
  Guide Sequence
guugggcccgccggguccuc

SEQ ID NO: 4359 - RNA, 20 nt, Artificial Sequence
  Guide Sequence
uccaagaguguugggcccgc

SEQ ID NO: 4360 - RNA, 20 nt, Artificial Sequence
  Guide Sequence
uggaggacccggcgggccca

SEQ ID NO: 4361 - RNA, 20 nt, Artificial Sequence
  Guide Sequence
ugggcccgccggguccucca

SEQ ID NO: 4362 - RNA, 20 nt, Artificial Sequence
  Guide Sequence
uguugggcccgccggguccu

SEQ ID NO: 4363 - RNA, 20 nt, Artificial Sequence
  Guide Sequence
uuggaggacccggcgggccc

SEQ ID NO: 4364 - RNA, 21 nt, Artificial Sequence
  Guide Sequence
aacacucuuggagccucggcu

SEQ ID NO: 4365 - RNA, 21 nt, Artificial Sequence
  Guide Sequence
aagaguguugggcccgccggg

SEQ ID NO: 4366 - RNA, 21 nt, Artificial Sequence
  Guide Sequence
acccggcgggcccaacacucu

SEQ ID NO: 4367 - RNA, 21 nt, Artificial Sequence
  Guide Sequence
agaguguugggcccgccgggu

SEQ ID NO: 4368 - RNA, 21 nt, Artificial Sequence
  Guide Sequence
agccgaggcuccaagaguguu

SEQ ID NO: 4369 - RNA, 21 nt, Artificial Sequence
  Guide Sequence
aggacccggcgggcccaacac

SEQ ID NO: 4370 - RNA, 21 nt, Artificial Sequence
  Guide Sequence
aggcuccaagaguguugggcc

SEQ ID NO: 4371 - RNA, 21 nt, Artificial Sequence
  Guide Sequence
agggcuuggaggacccggcgg

SEQ ID NO: 4372 - RNA, 21 nt, Artificial Sequence
  Guide Sequence
aguguugggcccgccgggucc

SEQ ID NO: 4373 - RNA, 21 nt, Artificial Sequence
  Guide Sequence
caacacucuuggagccucggc

SEQ ID NO: 4374 - RNA, 21 nt, Artificial Sequence
  Guide Sequence
caagaguguugggcccgccgg

SEQ ID NO: 4375 - RNA, 21 nt, Artificial Sequence
  Guide Sequence
ccaacacucuuggagccucgg

SEQ ID NO: 4376 - RNA, 21 nt, Artificial Sequence
  Guide Sequence
ccaagaguguugggcccgccg

SEQ ID NO: 4377 - RNA, 21 nt, Artificial Sequence
  Guide Sequence
cccaacacucuuggagccucg

SEQ ID NO: 4378 - RNA, 21 nt, Artificial Sequence
  Guide Sequence
cccggcgggcccaacacucuu

SEQ ID NO: 4379 - RNA, 21 nt, Artificial Sequence
  Guide Sequence
ccgaggcuccaagaguguugg

SEQ ID NO: 4380 - RNA, 21 nt, Artificial Sequence
  Guide Sequence
ccggcgggcccaacacucuug

SEQ ID NO: 4381 - RNA, 21 nt, Artificial Sequence
  Guide Sequence
cgaggcuccaagaguguuggg

SEQ ID NO: 4382 - RNA, 21 nt, Artificial Sequence
  Guide Sequence
cggcgggcccaacacucuugg

SEQ ID NO: 4383 - RNA, 21 nt, Artificial Sequence
  Guide Sequence
cgggcccaacacucuuggagc

SEQ ID NO: 4384 - RNA, 21 nt, Artificial Sequence
  Guide Sequence
cuccaagaguguugggcccgc

SEQ ID NO: 4385 - RNA, 21 nt, Artificial Sequence
  Guide Sequence
gacccggcgggcccaacacuc

SEQ ID NO: 4386 - RNA, 21 nt, Artificial Sequence
  Guide Sequence
gaggacccggcgggcccaaca

SEQ ID NO: 4387 - RNA, 21 nt, Artificial Sequence
  Guide Sequence
gaggcuccaagaguguugggc

SEQ ID NO: 4388 - RNA, 21 nt, Artificial Sequence
  Guide Sequence
gaguguugggcccgccggguc

SEQ ID NO: 4389 - RNA, 21 nt, Artificial Sequence
  Guide Sequence
gcccaacacucuuggagccuc

SEQ ID NO: 4390 - RNA, 21 nt, Artificial Sequence
  Guide Sequence
gccgaggcuccaagaguguug

SEQ ID NO: 4391 - RNA, 21 nt, Artificial Sequence
  Guide Sequence
gcgggcccaacacucuuggag

SEQ ID NO: 4392 - RNA, 21 nt, Artificial Sequence
  Guide Sequence
gcuccaagaguguugggcccg

SEQ ID NO: 4393 - RNA, 21 nt, Artificial Sequence
  Guide Sequence
ggacccggcgggcccaacacu

SEQ ID NO: 4394 - RNA, 21 nt, Artificial Sequence
  Guide Sequence
ggcccaacacucuuggagccu

SEQ ID NO: 4395 - RNA, 21 nt, Artificial Sequence
  Guide Sequence
ggcgggcccaacacucuugga

SEQ ID NO: 4396 - RNA, 21 nt, Artificial Sequence
  Guide Sequence
ggcuccaagaguguugggccc

SEQ ID NO: 4397 - RNA, 21 nt, Artificial Sequence
  Guide Sequence
gggcccaacacucuuggagcc

SEQ ID NO: 4398 - RNA, 21 nt, Artificial Sequence
  Guide Sequence
guguugggcccgccggguccu

SEQ ID NO: 4399 - RNA, 21 nt, Artificial Sequence
  Guide Sequence
uccaagaguguugggcccgcc

SEQ ID NO: 4400 - RNA, 21 nt, Artificial Sequence
  Guide Sequence
uggaggacccggcgggcccaa

SEQ ID NO: 4401 - RNA, 21 nt, Artificial Sequence
  Guide Sequence
ugggcccgccggguccuccaa

SEQ ID NO: 4402 - RNA, 21 nt, Artificial Sequence
  Guide Sequence
uguugggcccgccggguccuc

SEQ ID NO: 4403 - RNA, 21 nt, Artificial Sequence
  Guide Sequence
uuggaggacccggcgggccca

SEQ ID NO: 4404 - RNA, 22 nt, Artificial Sequence
  Guide Sequence
aacacucuuggagccucggcug

SEQ ID NO: 4405 - RNA, 22 nt, Artificial Sequence
  Guide Sequence
aagaguguugggcccgccgggu

SEQ ID NO: 4406 - RNA, 22 nt, Artificial Sequence
  Guide Sequence
acccggcgggcccaacacucuu

SEQ ID NO: 4407 - RNA, 22 nt, Artificial Sequence
  Guide Sequence
agaguguugggcccgccggguc

SEQ ID NO: 4408 - RNA, 22 nt, Artificial Sequence
  Guide Sequence
agccgaggcuccaagaguguug

SEQ ID NO: 4409 - RNA, 22 nt, Artificial Sequence
  Guide Sequence
aggacccggcgggcccaacacu

SEQ ID NO: 4410 - RNA, 22 nt, Artificial Sequence
  Guide Sequence
aggcuccaagaguguugggccc

SEQ ID NO: 4411 - RNA, 22 nt, Artificial Sequence
  Guide Sequence
agggcuuggaggacccggcggg

SEQ ID NO: 4412 - RNA, 22 nt, Artificial Sequence
  Guide Sequence
aguguugggcccgccggguccu

SEQ ID NO: 4413 - RNA, 22 nt, Artificial Sequence
  Guide Sequence
caacacucuuggagccucggcu

SEQ ID NO: 4414 - RNA, 22 nt, Artificial Sequence
  Guide Sequence
caagaguguugggcccgccggg

SEQ ID NO: 4415 - RNA, 22 nt, Artificial Sequence
  Guide Sequence
cagccgaggcuccaagaguguu

SEQ ID NO: 4416 - RNA, 22 nt, Artificial Sequence
  Guide Sequence
cagggcuuggaggacccggcgg

SEQ ID NO: 4417 - RNA, 22 nt, Artificial Sequence
  Guide Sequence
ccaacacucuuggagccucggc

SEQ ID NO: 4418 - RNA, 22 nt, Artificial Sequence
  Guide Sequence
ccaagaguguugggcccgccgg

SEQ ID NO: 4419 - RNA, 22 nt, Artificial Sequence
  Guide Sequence
cccaacacucuuggagccucgg

SEQ ID NO: 4420 - RNA, 22 nt, Artificial Sequence
  Guide Sequence
cccggcgggcccaacacucuug

SEQ ID NO: 4421 - RNA, 22 nt, Artificial Sequence
  Guide Sequence
ccgaggcuccaagaguguuggg

SEQ ID NO: 4422 - RNA, 22 nt, Artificial Sequence
  Guide Sequence
ccggcgggcccaacacucuugg

SEQ ID NO: 4423 - RNA, 22 nt, Artificial Sequence
  Guide Sequence
cgaggcuccaagaguguugggc

SEQ ID NO: 4424 - RNA, 22 nt, Artificial Sequence
  Guide Sequence
cggcgggcccaacacucuugga

SEQ ID NO: 4425 - RNA, 22 nt, Artificial Sequence
  Guide Sequence
cgggcccaacacucuuggagcc

SEQ ID NO: 4426 - RNA, 22 nt, Artificial Sequence
  Guide Sequence
cuccaagaguguugggcccgcc

SEQ ID NO: 4427 - RNA, 22 nt, Artificial Sequence
  Guide Sequence
cuuggaggacccggcgggccca

SEQ ID NO: 4428 - RNA, 22 nt, Artificial Sequence
  Guide Sequence
gacccggcgggcccaacacucu

SEQ ID NO: 4429 - RNA, 22 nt, Artificial Sequence
  Guide Sequence
gaggacccggcgggcccaacac

SEQ ID NO: 4430 - RNA, 22 nt, Artificial Sequence
  Guide Sequence
gaggcuccaagaguguugggcc

SEQ ID NO: 4431 - RNA, 22 nt, Artificial Sequence
  Guide Sequence
gaguguugggcccgccgggucc

SEQ ID NO: 4432 - RNA, 22 nt, Artificial Sequence
  Guide Sequence
gcccaacacucuuggagccucg

SEQ ID NO: 4433 - RNA, 22 nt, Artificial Sequence
  Guide Sequence
gccgaggcuccaagaguguugg

SEQ ID NO: 4434 - RNA, 22 nt, Artificial Sequence
  Guide Sequence
gcgggcccaacacucuuggagc

SEQ ID NO: 4435 - RNA, 22 nt, Artificial Sequence
  Guide Sequence
gcuccaagaguguugggcccgc

SEQ ID NO: 4436 - RNA, 22 nt, Artificial Sequence
  Guide Sequence
ggacccggcgggcccaacacuc

SEQ ID NO: 4437 - RNA, 22 nt, Artificial Sequence
  Guide Sequence
ggaggacccggcgggcccaaca

SEQ ID NO: 4438 - RNA, 22 nt, Artificial Sequence
  Guide Sequence
ggcccaacacucuuggagccuc

SEQ ID NO: 4439 - RNA, 22 nt, Artificial Sequence
  Guide Sequence
ggcgggcccaacacucuuggag

SEQ ID NO: 4440 - RNA, 22 nt, Artificial Sequence
  Guide Sequence
ggcuccaagaguguugggcccg

SEQ ID NO: 4441 - RNA, 22 nt, Artificial Sequence
  Guide Sequence
gggcccaacacucuuggagccu

SEQ ID NO: 4442 - RNA, 22 nt, Artificial Sequence
  Guide Sequence
guguugggcccgccggguccuc

SEQ ID NO: 4443 - RNA, 22 nt, Artificial Sequence
  Guide Sequence
guugggcccgccggguccucca

SEQ ID NO: 4444 - RNA, 22 nt, Artificial Sequence
  Guide Sequence
uccaagaguguugggcccgccg

SEQ ID NO: 4445 - RNA, 22 nt, Artificial Sequence
  Guide Sequence
uggaggacccggcgggcccaac

SEQ ID NO: 4446 - RNA, 22 nt, Artificial Sequence
  Guide Sequence
ugggcccgccggguccuccaag

SEQ ID NO: 4447 - RNA, 22 nt, Artificial Sequence
  Guide Sequence
uguugggcccgccggguccucc

SEQ ID NO: 4448 - RNA, 22 nt, Artificial Sequence
  Guide Sequence
uuggaggacccggcgggcccaa

SEQ ID NO: 4449 - RNA, 20 nt, Artificial Sequence
  Guide Sequence
aagaguguggcccgccgguc

SEQ ID NO: 4450 - RNA, 20 nt, Artificial Sequence
  Guide Sequence
accggcgggccacacucuug

SEQ ID NO: 4451 - RNA, 20 nt, Artificial Sequence
  Guide Sequence
agaguguggcccgccggucc

SEQ ID NO: 4452 - RNA, 20 nt, Artificial Sequence
  Guide Sequence
aggaccggcgggccacacuc

SEQ ID NO: 4453 - RNA, 20 nt, Artificial Sequence
  Guide Sequence
aggcuccaagaguguggccc

SEQ ID NO: 4454 - RNA, 20 nt, Artificial Sequence
  Guide Sequence
agggcuuggaggaccggcgg

SEQ ID NO: 4455 - RNA, 20 nt, Artificial Sequence
  Guide Sequence
aguguggcccgccgguccuc

SEQ ID NO: 4456 - RNA, 20 nt, Artificial Sequence
  Guide Sequence
caagaguguggcccgccggu

SEQ ID NO: 4457 - RNA, 20 nt, Artificial Sequence
  Guide Sequence
cagggcuuggaggaccggcg

SEQ ID NO: 4458 - RNA, 20 nt, Artificial Sequence
  Guide Sequence
ccaagaguguggcccgccgg

SEQ ID NO: 4459 - RNA, 20 nt, Artificial Sequence
  Guide Sequence
ccagggcuuggaggaccggc

SEQ ID NO: 4460 - RNA, 20 nt, Artificial Sequence
  Guide Sequence
ccccuccagggcuuggagga

SEQ ID NO: 4461 - RNA, 20 nt, Artificial Sequence
  Guide Sequence
cccgccgguccuccaagccc

SEQ ID NO: 4462 - RNA, 20 nt, Artificial Sequence
  Guide Sequence
cccuccagggcuuggaggac

SEQ ID NO: 4463 - RNA, 20 nt, Artificial Sequence
  Guide Sequence
ccgccgguccuccaagcccu

SEQ ID NO: 4464 - RNA, 20 nt, Artificial Sequence
  Guide Sequence
ccgguccuccaagcccugga

SEQ ID NO: 4465 - RNA, 20 nt, Artificial Sequence
  Guide Sequence
ccuccagggcuuggaggacc

SEQ ID NO: 4466 - RNA, 20 nt, Artificial Sequence
  Guide Sequence
cgccgguccuccaagcccug

SEQ ID NO: 4467 - RNA, 20 nt, Artificial Sequence
  Guide Sequence
cuccaagaguguggcccgcc

SEQ ID NO: 4468 - RNA, 20 nt, Artificial Sequence
  Guide Sequence
cuccagggcuuggaggaccg

SEQ ID NO: 4469 - RNA, 20 nt, Artificial Sequence
  Guide Sequence
cuuggaggaccggcgggcca

SEQ ID NO: 4470 - RNA, 20 nt, Artificial Sequence
  Guide Sequence
gaccggcgggccacacucuu

SEQ ID NO: 4471 - RNA, 20 nt, Artificial Sequence
  Guide Sequence
gaggaccggcgggccacacu

SEQ ID NO: 4472 - RNA, 20 nt, Artificial Sequence
  Guide Sequence
gaguguggcccgccgguccu

SEQ ID NO: 4473 - RNA, 20 nt, Artificial Sequence
  Guide Sequence
gccccuccagggcuuggagg

SEQ ID NO: 4474 - RNA, 20 nt, Artificial Sequence
  Guide Sequence
gcccgccgguccuccaagcc

SEQ ID NO: 4475 - RNA, 20 nt, Artificial Sequence
  Guide Sequence
gccgguccuccaagcccugg

SEQ ID NO: 4476 - RNA, 20 nt, Artificial Sequence
  Guide Sequence
gcuuggaggaccggcgggcc

SEQ ID NO: 4477 - RNA, 20 nt, Artificial Sequence
  Guide Sequence
ggaccggcgggccacacucu

SEQ ID NO: 4478 - RNA, 20 nt, Artificial Sequence
  Guide Sequence
ggaggaccggcgggccacac

SEQ ID NO: 4479 - RNA, 20 nt, Artificial Sequence
  Guide Sequence
ggcccgccgguccuccaagc

SEQ ID NO: 4480 - RNA, 20 nt, Artificial Sequence
  Guide Sequence
ggcuuggaggaccggcgggc

SEQ ID NO: 4481 - RNA, 20 nt, Artificial Sequence
  Guide Sequence
gggcuuggaggaccggcggg

SEQ ID NO: 4482 - RNA, 20 nt, Artificial Sequence
  Guide Sequence
guggcccgccgguccuccaa

SEQ ID NO: 4483 - RNA, 20 nt, Artificial Sequence
  Guide Sequence
guguggcccgccgguccucc

SEQ ID NO: 4484 - RNA, 20 nt, Artificial Sequence
  Guide Sequence
uccaagaguguggcccgccg

SEQ ID NO: 4485 - RNA, 20 nt, Artificial Sequence
  Guide Sequence
uccagggcuuggaggaccgg

SEQ ID NO: 4486 - RNA, 20 nt, Artificial Sequence
  Guide Sequence
uggaggaccggcgggccaca

SEQ ID NO: 4487 - RNA, 20 nt, Artificial Sequence
  Guide Sequence
uggcccgccgguccuccaag

SEQ ID NO: 4488 - RNA, 20 nt, Artificial Sequence
  Guide Sequence
uguggcccgccgguccucca

SEQ ID NO: 4489 - RNA, 20 nt, Artificial Sequence
  Guide Sequence
uuggaggaccggcgggccac

SEQ ID NO: 4490 - RNA, 21 nt, Artificial Sequence
  Guide Sequence
aagaguguggcccgccggucc

SEQ ID NO: 4491 - RNA, 21 nt, Artificial Sequence
  Guide Sequence
accggcgggccacacucuugg

SEQ ID NO: 4492 - RNA, 21 nt, Artificial Sequence
  Guide Sequence
agaguguggcccgccgguccu

SEQ ID NO: 4493 - RNA, 21 nt, Artificial Sequence
  Guide Sequence
agccccuccagggcuuggagg

SEQ ID NO: 4494 - RNA, 21 nt, Artificial Sequence
  Guide Sequence
aggaccggcgggccacacucu

SEQ ID NO: 4495 - RNA, 21 nt, Artificial Sequence
  Guide Sequence
aggcuccaagaguguggcccg

SEQ ID NO: 4496 - RNA, 21 nt, Artificial Sequence
  Guide Sequence
agggcuuggaggaccggcggg

SEQ ID NO: 4497 - RNA, 21 nt, Artificial Sequence
  Guide Sequence
aguguggcccgccgguccucc

SEQ ID NO: 4498 - RNA, 21 nt, Artificial Sequence
  Guide Sequence
caagaguguggcccgccgguc

SEQ ID NO: 4499 - RNA, 21 nt, Artificial Sequence
  Guide Sequence
cagggcuuggaggaccggcgg

SEQ ID NO: 4500 - RNA, 21 nt, Artificial Sequence
  Guide Sequence
ccaagaguguggcccgccggu

SEQ ID NO: 4501 - RNA, 21 nt, Artificial Sequence
  Guide Sequence
ccagggcuuggaggaccggcg

SEQ ID NO: 4502 - RNA, 21 nt, Artificial Sequence
  Guide Sequence
ccccuccagggcuuggaggac

SEQ ID NO: 4503 - RNA, 21 nt, Artificial Sequence
  Guide Sequence
cccgccgguccuccaagcccu

SEQ ID NO: 4504 - RNA, 21 nt, Artificial Sequence
  Guide Sequence
cccuccagggcuuggaggacc

SEQ ID NO: 4505 - RNA, 21 nt, Artificial Sequence
  Guide Sequence
ccgccgguccuccaagcccug

SEQ ID NO: 4506 - RNA, 21 nt, Artificial Sequence
  Guide Sequence
ccgguccuccaagcccuggag

SEQ ID NO: 4507 - RNA, 21 nt, Artificial Sequence
  Guide Sequence
ccuccagggcuuggaggaccg

SEQ ID NO: 4508 - RNA, 21 nt, Artificial Sequence
  Guide Sequence
cgaggcuccaagaguguggcc

SEQ ID NO: 4509 - RNA, 21 nt, Artificial Sequence
  Guide Sequence
cgccgguccuccaagcccugg

SEQ ID NO: 4510 - RNA, 21 nt, Artificial Sequence
  Guide Sequence
cuccaagaguguggcccgccg

SEQ ID NO: 4511 - RNA, 21 nt, Artificial Sequence
  Guide Sequence
cuccagggcuuggaggaccgg

SEQ ID NO: 4512 - RNA, 21 nt, Artificial Sequence
  Guide Sequence
cuuggaggaccggcgggccac

SEQ ID NO: 4513 - RNA, 21 nt, Artificial Sequence
  Guide Sequence
gaccggcgggccacacucuug

SEQ ID NO: 4514 - RNA, 21 nt, Artificial Sequence
  Guide Sequence
gaggaccggcgggccacacuc

SEQ ID NO: 4515 - RNA, 21 nt, Artificial Sequence
  Guide Sequence
gaguguggcccgccgguccuc

SEQ ID NO: 4516 - RNA, 21 nt, Artificial Sequence
  Guide Sequence
gccccuccagggcuuggagga

SEQ ID NO: 4517 - RNA, 21 nt, Artificial Sequence
  Guide Sequence
gccgguccuccaagcccugga

SEQ ID NO: 4518 - RNA, 21 nt, Artificial Sequence
  Guide Sequence
gcuuggaggaccggcgggcca

SEQ ID NO: 4519 - RNA, 21 nt, Artificial Sequence
  Guide Sequence
ggaccggcgggccacacucuu

SEQ ID NO: 4520 - RNA, 21 nt, Artificial Sequence
  Guide Sequence
ggaggaccggcgggccacacu

SEQ ID NO: 4521 - RNA, 21 nt, Artificial Sequence
  Guide Sequence
guggcccgccgguccuccaag

SEQ ID NO: 4522 - RNA, 21 nt, Artificial Sequence
  Guide Sequence
guguggcccgccgguccucca

SEQ ID NO: 4523 - RNA, 21 nt, Artificial Sequence
  Guide Sequence
uccaagaguguggcccgccgg

SEQ ID NO: 4524 - RNA, 21 nt, Artificial Sequence
  Guide Sequence
uccagggcuuggaggaccggc

SEQ ID NO: 4525 - RNA, 21 nt, Artificial Sequence
  Guide Sequence
uggaggaccggcgggccacac

SEQ ID NO: 4526 - RNA, 21 nt, Artificial Sequence
  Guide Sequence
uggcccgccgguccuccaagc

SEQ ID NO: 4527 - RNA, 21 nt, Artificial Sequence
  Guide Sequence
uguggcccgccgguccuccaa

SEQ ID NO: 4528 - RNA, 21 nt, Artificial Sequence
  Guide Sequence
uuggaggaccggcgggccaca

SEQ ID NO: 4529 - RNA, 22 nt, Artificial Sequence
  Guide Sequence
aagaguguggcccgccgguccu

SEQ ID NO: 4530 - RNA, 22 nt, Artificial Sequence
  Guide Sequence
accggcgggccacacucuugga

SEQ ID NO: 4531 - RNA, 22 nt, Artificial Sequence
  Guide Sequence
agaguguggcccgccgguccuc

SEQ ID NO: 4532 - RNA, 22 nt, Artificial Sequence
  Guide Sequence
agccccuccagggcuuggagga

SEQ ID NO: 4533 - RNA, 22 nt, Artificial Sequence
  Guide Sequence
aggaccggcgggccacacucuu

SEQ ID NO: 4534 - RNA, 22 nt, Artificial Sequence
  Guide Sequence
aggcuccaagaguguggcccgc

SEQ ID NO: 4535 - RNA, 22 nt, Artificial Sequence
  Guide Sequence
agggcuuggaggaccggcgggc

SEQ ID NO: 4536 - RNA, 22 nt, Artificial Sequence
  Guide Sequence
aguguggcccgccgguccucca

SEQ ID NO: 4537 - RNA, 22 nt, Artificial Sequence
  Guide Sequence
caagaguguggcccgccggucc

SEQ ID NO: 4538 - RNA, 22 nt, Artificial Sequence
  Guide Sequence
cagccccuccagggcuuggagg

SEQ ID NO: 4539 - RNA, 22 nt, Artificial Sequence
  Guide Sequence
cagggcuuggaggaccggcggg

SEQ ID NO: 4540 - RNA, 22 nt, Artificial Sequence
  Guide Sequence
ccaagaguguggcccgccgguc

SEQ ID NO: 4541 - RNA, 22 nt, Artificial Sequence
  Guide Sequence
ccagggcuuggaggaccggcgg

SEQ ID NO: 4542 - RNA, 22 nt, Artificial Sequence
  Guide Sequence
ccccuccagggcuuggaggacc

SEQ ID NO: 4543 - RNA, 22 nt, Artificial Sequence
  Guide Sequence
cccgccgguccuccaagcccug

SEQ ID NO: 4544 - RNA, 22 nt, Artificial Sequence
  Guide Sequence
cccuccagggcuuggaggaccg

SEQ ID NO: 4545 - RNA, 22 nt, Artificial Sequence
  Guide Sequence
ccgaggcuccaagaguguggcc

SEQ ID NO: 4546 - RNA, 22 nt, Artificial Sequence
  Guide Sequence
ccgccgguccuccaagcccugg

SEQ ID NO: 4547 - RNA, 22 nt, Artificial Sequence
  Guide Sequence
ccgguccuccaagcccuggagg

SEQ ID NO: 4548 - RNA, 22 nt, Artificial Sequence
  Guide Sequence
ccuccagggcuuggaggaccgg

SEQ ID NO: 4549 - RNA, 22 nt, Artificial Sequence
  Guide Sequence
cgaggcuccaagaguguggccc

SEQ ID NO: 4550 - RNA, 22 nt, Artificial Sequence
  Guide Sequence
cgccgguccuccaagcccugga

SEQ ID NO: 4551 - RNA, 22 nt, Artificial Sequence
  Guide Sequence
cuccaagaguguggcccgccgg

SEQ ID NO: 4552 - RNA, 22 nt, Artificial Sequence
  Guide Sequence
cuccagggcuuggaggaccggc

SEQ ID NO: 4553 - RNA, 22 nt, Artificial Sequence
  Guide Sequence
cuuggaggaccggcgggccaca

SEQ ID NO: 4554 - RNA, 22 nt, Artificial Sequence
  Guide Sequence
gaccggcgggccacacucuugg

SEQ ID NO: 4555 - RNA, 22 nt, Artificial Sequence
  Guide Sequence
gaggaccggcgggccacacucu

SEQ ID NO: 4556 - RNA, 22 nt, Artificial Sequence
  Guide Sequence
gaguguggcccgccgguccucc

SEQ ID NO: 4557 - RNA, 22 nt, Artificial Sequence
  Guide Sequence
gccccuccagggcuuggaggac

SEQ ID NO: 4558 - RNA, 22 nt, Artificial Sequence
  Guide Sequence
gcccgccgguccuccaagcccu

SEQ ID NO: 4559 - RNA, 22 nt, Artificial Sequence
  Guide Sequence
gccgguccuccaagcccuggag

SEQ ID NO: 4560 - RNA, 22 nt, Artificial Sequence
  Guide Sequence
gcuuggaggaccggcgggccac

SEQ ID NO: 4561 - RNA, 22 nt, Artificial Sequence
  Guide Sequence
ggaccggcgggccacacucuug

SEQ ID NO: 4562 - RNA, 22 nt, Artificial Sequence
  Guide Sequence
ggaggaccggcgggccacacuc

SEQ ID NO: 4563 - RNA, 22 nt, Artificial Sequence
  Guide Sequence
ggcuuggaggaccggcgggcca

SEQ ID NO: 4564 - RNA, 22 nt, Artificial Sequence
  Guide Sequence
guggcccgccgguccuccaagc

SEQ ID NO: 4565 - RNA, 22 nt, Artificial Sequence
  Guide Sequence
guguggcccgccgguccuccaa

SEQ ID NO: 4566 - RNA, 22 nt, Artificial Sequence
  Guide Sequence
uccaagaguguggcccgccggu

SEQ ID NO: 4567 - RNA, 22 nt, Artificial Sequence
  Guide Sequence
uccagggcuuggaggaccggcg

SEQ ID NO: 4568 - RNA, 22 nt, Artificial Sequence
  Guide Sequence
uggaggaccggcgggccacacu

SEQ ID NO: 4569 - RNA, 22 nt, Artificial Sequence
  Guide Sequence
uggcccgccgguccuccaagcc

SEQ ID NO: 4570 - RNA, 22 nt, Artificial Sequence
  Guide Sequence
uguggcccgccgguccuccaag

SEQ ID NO: 4571 - RNA, 22 nt, Artificial Sequence
  Guide Sequence
uuggaggaccggcgggccacac

SEQ ID NO: 4572 - RNA, 20 nt, Artificial Sequence
  Guide Sequence
aagaguguggcccgccggga

SEQ ID NO: 4573 - RNA, 20 nt, Artificial Sequence
  Guide Sequence
agaguguggcccgccgggac

SEQ ID NO: 4574 - RNA, 20 nt, Artificial Sequence
  Guide Sequence
agccccuccagggcuuggag

SEQ ID NO: 4575 - RNA, 20 nt, Artificial Sequence
  Guide Sequence
agggcuuggaggucccggcg

SEQ ID NO: 4576 - RNA, 20 nt, Artificial Sequence
  Guide Sequence
aggucccggcgggccacacu

SEQ ID NO: 4577 - RNA, 20 nt, Artificial Sequence
  Guide Sequence
aguguggcccgccgggaccu

SEQ ID NO: 4578 - RNA, 20 nt, Artificial Sequence
  Guide Sequence
caagaguguggcccgccggg

SEQ ID NO: 4579 - RNA, 20 nt, Artificial Sequence
  Guide Sequence
cagccccuccagggcuugga

SEQ ID NO: 4580 - RNA, 20 nt, Artificial Sequence
  Guide Sequence
cagggcuuggaggucccggc

SEQ ID NO: 4581 - RNA, 20 nt, Artificial Sequence
  Guide Sequence
ccagggcuuggaggucccgg

SEQ ID NO: 4582 - RNA, 20 nt, Artificial Sequence
  Guide Sequence
ccccuccagggcuuggaggu

SEQ ID NO: 4583 - RNA, 20 nt, Artificial Sequence
  Guide Sequence
cccgccgggaccuccaagcc

SEQ ID NO: 4584 - RNA, 20 nt, Artificial Sequence
  Guide Sequence
cccuccagggcuuggagguc

SEQ ID NO: 4585 - RNA, 20 nt, Artificial Sequence
  Guide Sequence
ccgccgggaccuccaagccc

SEQ ID NO: 4586 - RNA, 20 nt, Artificial Sequence
  Guide Sequence
ccgggaccuccaagcccugg

SEQ ID NO: 4587 - RNA, 20 nt, Artificial Sequence
  Guide Sequence
ccuccagggcuuggaggucc

SEQ ID NO: 4588 - RNA, 20 nt, Artificial Sequence
  Guide Sequence
cgccgggaccuccaagcccu

SEQ ID NO: 4589 - RNA, 20 nt, Artificial Sequence
  Guide Sequence
cgggaccuccaagcccugga

SEQ ID NO: 4590 - RNA, 20 nt, Artificial Sequence
  Guide Sequence
cuccagggcuuggagguccc

SEQ ID NO: 4591 - RNA, 20 nt, Artificial Sequence
  Guide Sequence
cuuggaggucccggcgggcc

SEQ ID NO: 4592 - RNA, 20 nt, Artificial Sequence
  Guide Sequence
gaccuccaagcccuggaggg

SEQ ID NO: 4593 - RNA, 20 nt, Artificial Sequence
  Guide Sequence
gaggucccggcgggccacac

SEQ ID NO: 4594 - RNA, 20 nt, Artificial Sequence
  Guide Sequence
gaguguggcccgccgggacc

SEQ ID NO: 4595 - RNA, 20 nt, Artificial Sequence
  Guide Sequence
gcccgccgggaccuccaagc

SEQ ID NO: 4596 - RNA, 20 nt, Artificial Sequence
  Guide Sequence
gccgggaccuccaagcccug

SEQ ID NO: 4597 - RNA, 20 nt, Artificial Sequence
  Guide Sequence
gcuuggaggucccggcgggc

SEQ ID NO: 4598 - RNA, 20 nt, Artificial Sequence
  Guide Sequence
ggaccuccaagcccuggagg

SEQ ID NO: 4599 - RNA, 20 nt, Artificial Sequence
  Guide Sequence
ggaggucccggcgggccaca

SEQ ID NO: 4600 - RNA, 20 nt, Artificial Sequence
  Guide Sequence
ggcccgccgggaccuccaag

SEQ ID NO: 4601 - RNA, 20 nt, Artificial Sequence
  Guide Sequence
ggcuuggaggucccggcggg

SEQ ID NO: 4602 - RNA, 20 nt, Artificial Sequence
  Guide Sequence
gggaccuccaagcccuggag

SEQ ID NO: 4603 - RNA, 20 nt, Artificial Sequence
  Guide Sequence
gggcuuggaggucccggcgg

SEQ ID NO: 4604 - RNA, 20 nt, Artificial Sequence
  Guide Sequence
ggucccggcgggccacacuc

SEQ ID NO: 4605 - RNA, 20 nt, Artificial Sequence
  Guide Sequence
gucccggcgggccacacucu

SEQ ID NO: 4606 - RNA, 20 nt, Artificial Sequence
  Guide Sequence
guggcccgccgggaccucca

SEQ ID NO: 4607 - RNA, 20 nt, Artificial Sequence
  Guide Sequence
guguggcccgccgggaccuc

SEQ ID NO: 4608 - RNA, 20 nt, Artificial Sequence
  Guide Sequence
ucagccccuccagggcuugg

SEQ ID NO: 4609 - RNA, 20 nt, Artificial Sequence
  Guide Sequence
uccagggcuuggaggucccg

SEQ ID NO: 4610 - RNA, 20 nt, Artificial Sequence
  Guide Sequence
uggaggucccggcgggccac

SEQ ID NO: 4611 - RNA, 20 nt, Artificial Sequence
  Guide Sequence
uggcccgccgggaccuccaa

SEQ ID NO: 4612 - RNA, 20 nt, Artificial Sequence
  Guide Sequence
uguggcccgccgggaccucc

SEQ ID NO: 4613 - RNA, 20 nt, Artificial Sequence
  Guide Sequence
uuggaggucccggcgggcca

SEQ ID NO: 4614 - RNA, 21 nt, Artificial Sequence
  Guide Sequence
aagaguguggcccgccgggac

SEQ ID NO: 4615 - RNA, 21 nt, Artificial Sequence
  Guide Sequence
agaguguggcccgccgggacc

SEQ ID NO: 4616 - RNA, 21 nt, Artificial Sequence
  Guide Sequence
agggcuuggaggucccggcgg

SEQ ID NO: 4617 - RNA, 21 nt, Artificial Sequence
  Guide Sequence
aggucccggcgggccacacuc

SEQ ID NO: 4618 - RNA, 21 nt, Artificial Sequence
  Guide Sequence
aguguggcccgccgggaccuc

SEQ ID NO: 4619 - RNA, 21 nt, Artificial Sequence
  Guide Sequence
caagaguguggcccgccggga

SEQ ID NO: 4620 - RNA, 21 nt, Artificial Sequence
  Guide Sequence
cagccccuccagggcuuggag

SEQ ID NO: 4621 - RNA, 21 nt, Artificial Sequence
  Guide Sequence
cagggcuuggaggucccggcg

SEQ ID NO: 4622 - RNA, 21 nt, Artificial Sequence
  Guide Sequence
ccaagaguguggcccgccggg

SEQ ID NO: 4623 - RNA, 21 nt, Artificial Sequence
  Guide Sequence
ccagggcuuggaggucccggc

SEQ ID NO: 4624 - RNA, 21 nt, Artificial Sequence
  Guide Sequence
ccccuccagggcuuggagguc

SEQ ID NO: 4625 - RNA, 21 nt, Artificial Sequence
  Guide Sequence
cccuccagggcuuggaggucc

SEQ ID NO: 4626 - RNA, 21 nt, Artificial Sequence
  Guide Sequence
ccgccgggaccuccaagcccu

SEQ ID NO: 4627 - RNA, 21 nt, Artificial Sequence
  Guide Sequence
ccgggaccuccaagcccugga

SEQ ID NO: 4628 - RNA, 21 nt, Artificial Sequence
  Guide Sequence
ccuccagggcuuggagguccc

SEQ ID NO: 4629 - RNA, 21 nt, Artificial Sequence
  Guide Sequence
cgccgggaccuccaagcccug

SEQ ID NO: 4630 - RNA, 21 nt, Artificial Sequence
  Guide Sequence
cgggaccuccaagcccuggag

SEQ ID NO: 4631 - RNA, 21 nt, Artificial Sequence
  Guide Sequence
cuccagggcuuggaggucccg

SEQ ID NO: 4632 - RNA, 21 nt, Artificial Sequence
  Guide Sequence
cuuggaggucccggcgggcca

SEQ ID NO: 4633 - RNA, 21 nt, Artificial Sequence
  Guide Sequence
gaccuccaagcccuggagggg

SEQ ID NO: 4634 - RNA, 21 nt, Artificial Sequence
  Guide Sequence
gaggucccggcgggccacacu

SEQ ID NO: 4635 - RNA, 21 nt, Artificial Sequence
  Guide Sequence
gaguguggcccgccgggaccu

SEQ ID NO: 4636 - RNA, 21 nt, Artificial Sequence
  Guide Sequence
gccccuccagggcuuggaggu

SEQ ID NO: 4637 - RNA, 21 nt, Artificial Sequence
  Guide Sequence
gccgggaccuccaagcccugg

SEQ ID NO: 4638 - RNA, 21 nt, Artificial Sequence
  Guide Sequence
ggaccuccaagcccuggaggg

SEQ ID NO: 4639 - RNA, 21 nt, Artificial Sequence
  Guide Sequence
gggaccuccaagcccuggagg

SEQ ID NO: 4640 - RNA, 21 nt, Artificial Sequence
  Guide Sequence
ggucccggcgggccacacucu

SEQ ID NO: 4641 - RNA, 21 nt, Artificial Sequence
  Guide Sequence
gucccggcgggccacacucuu

SEQ ID NO: 4642 - RNA, 21 nt, Artificial Sequence
  Guide Sequence
guggcccgccgggaccuccaa

SEQ ID NO: 4643 - RNA, 21 nt, Artificial Sequence
  Guide Sequence
ucagccccuccagggcuugga

SEQ ID NO: 4644 - RNA, 21 nt, Artificial Sequence
  Guide Sequence
uccagggcuuggaggucccgg

SEQ ID NO: 4645 - RNA, 21 nt, Artificial Sequence
  Guide Sequence
uggaggucccggcgggccaca

SEQ ID NO: 4646 - RNA, 21 nt, Artificial Sequence
  Guide Sequence
uggcccgccgggaccuccaag

SEQ ID NO: 4647 - RNA, 21 nt, Artificial Sequence
  Guide Sequence
uguggcccgccgggaccucca

SEQ ID NO: 4648 - RNA, 21 nt, Artificial Sequence
  Guide Sequence
uucagccccuccagggcuugg

SEQ ID NO: 4649 - RNA, 21 nt, Artificial Sequence
  Guide Sequence
uuggaggucccggcgggccac

SEQ ID NO: 4650 - RNA, 22 nt, Artificial Sequence
  Guide Sequence
aagaguguggcccgccgggacc

SEQ ID NO: 4651 - RNA, 22 nt, Artificial Sequence
  Guide Sequence
agaguguggcccgccgggaccu

SEQ ID NO: 4652 - RNA, 22 nt, Artificial Sequence
  Guide Sequence
agccccuccagggcuuggaggu

SEQ ID NO: 4653 - RNA, 22 nt, Artificial Sequence
  Guide Sequence
agggcuuggaggucccggcggg

SEQ ID NO: 4654 - RNA, 22 nt, Artificial Sequence
  Guide Sequence
aggucccggcgggccacacucu

SEQ ID NO: 4655 - RNA, 22 nt, Artificial Sequence
  Guide Sequence
aguguggcccgccgggaccucc

SEQ ID NO: 4656 - RNA, 22 nt, Artificial Sequence
  Guide Sequence
caagaguguggcccgccgggac

SEQ ID NO: 4657 - RNA, 22 nt, Artificial Sequence
  Guide Sequence
cagggcuuggaggucccggcgg

SEQ ID NO: 4658 - RNA, 22 nt, Artificial Sequence
  Guide Sequence
ccaagaguguggcccgccggga

SEQ ID NO: 4659 - RNA, 22 nt, Artificial Sequence
  Guide Sequence
ccagggcuuggaggucccggcg

SEQ ID NO: 4660 - RNA, 22 nt, Artificial Sequence
  Guide Sequence
ccccuccagggcuuggaggucc

SEQ ID NO: 4661 - RNA, 22 nt, Artificial Sequence
  Guide Sequence
cccgccgggaccuccaagcccu

SEQ ID NO: 4662 - RNA, 22 nt, Artificial Sequence
  Guide Sequence
cccuccagggcuuggagguccc

SEQ ID NO: 4663 - RNA, 22 nt, Artificial Sequence
  Guide Sequence
ccgccgggaccuccaagcccug

SEQ ID NO: 4664 - RNA, 22 nt, Artificial Sequence
  Guide Sequence
ccgggaccuccaagcccuggag

SEQ ID NO: 4665 - RNA, 22 nt, Artificial Sequence
  Guide Sequence
ccuccagggcuuggaggucccg

SEQ ID NO: 4666 - RNA, 22 nt, Artificial Sequence
  Guide Sequence
cgccgggaccuccaagcccugg

SEQ ID NO: 4667 - RNA, 22 nt, Artificial Sequence
  Guide Sequence
cgggaccuccaagcccuggagg

SEQ ID NO: 4668 - RNA, 22 nt, Artificial Sequence
  Guide Sequence
cuccagggcuuggaggucccgg

SEQ ID NO: 4669 - RNA, 22 nt, Artificial Sequence
  Guide Sequence
cuuggaggucccggcgggccac

SEQ ID NO: 4670 - RNA, 22 nt, Artificial Sequence
  Guide Sequence
gaccuccaagcccuggaggggc

SEQ ID NO: 4671 - RNA, 22 nt, Artificial Sequence
  Guide Sequence
gaggucccggcgggccacacuc

SEQ ID NO: 4672 - RNA, 22 nt, Artificial Sequence
  Guide Sequence
gaguguggcccgccgggaccuc

SEQ ID NO: 4673 - RNA, 22 nt, Artificial Sequence
  Guide Sequence
gccccuccagggcuuggagguc

SEQ ID NO: 4674 - RNA, 22 nt, Artificial Sequence
  Guide Sequence
gccgggaccuccaagcccugga

SEQ ID NO: 4675 - RNA, 22 nt, Artificial Sequence
  Guide Sequence
gcuuggaggucccggcgggcca

SEQ ID NO: 4676 - RNA, 22 nt, Artificial Sequence
  Guide Sequence
ggaccuccaagcccuggagggg

SEQ ID NO: 4677 - RNA, 22 nt, Artificial Sequence
  Guide Sequence
ggaggucccggcgggccacacu

SEQ ID NO: 4678 - RNA, 22 nt, Artificial Sequence
  Guide Sequence
gggaccuccaagcccuggaggg

SEQ ID NO: 4679 - RNA, 22 nt, Artificial Sequence
  Guide Sequence
ggucccggcgggccacacucuu

SEQ ID NO: 4680 - RNA, 22 nt, Artificial Sequence
  Guide Sequence
gucccggcgggccacacucuug

SEQ ID NO: 4681 - RNA, 22 nt, Artificial Sequence
  Guide Sequence
guggcccgccgggaccuccaag

SEQ ID NO: 4682 - RNA, 22 nt, Artificial Sequence
  Guide Sequence
guguggcccgccgggaccucca

SEQ ID NO: 4683 - RNA, 22 nt, Artificial Sequence
  Guide Sequence
ucagccccuccagggcuuggag

SEQ ID NO: 4684 - RNA, 22 nt, Artificial Sequence
  Guide Sequence
uccaagaguguggcccgccggg

SEQ ID NO: 4685 - RNA, 22 nt, Artificial Sequence
  Guide Sequence
uccagggcuuggaggucccggc

SEQ ID NO: 4686 - RNA, 22 nt, Artificial Sequence
  Guide Sequence
uggaggucccggcgggccacac

SEQ ID NO: 4687 - RNA, 22 nt, Artificial Sequence
  Guide Sequence
uggcccgccgggaccuccaagc

SEQ ID NO: 4688 - RNA, 22 nt, Artificial Sequence
  Guide Sequence
uguggcccgccgggaccuccaa

SEQ ID NO: 4689 - RNA, 22 nt, Artificial Sequence
  Guide Sequence
uucagccccuccagggcuugga

SEQ ID NO: 4690 - RNA, 22 nt, Artificial Sequence
  Guide Sequence
uuggaggucccggcgggccaca

SEQ ID NO: 4691 - RNA, 22 nt, Artificial Sequence
  Guide Sequence
uuucagccccuccagggcuugg

SEQ ID NO: 4692 - RNA, 20 nt, Artificial Sequence
  Guide Sequence
aaaaugaugguggaaaagga

SEQ ID NO: 4693 - RNA, 20 nt, Artificial Sequence
  Guide Sequence
aaaugaugguggaaaaggac

SEQ ID NO: 4694 - RNA, 20 nt, Artificial Sequence
  Guide Sequence
aagcccuggaggggcugaaa

SEQ ID NO: 4695 - RNA, 20 nt, Artificial Sequence
  Guide Sequence
aaugaugguggaaaaggacc

SEQ ID NO: 4696 - RNA, 20 nt, Artificial Sequence
  Guide Sequence
accaucauuuucagccccuc

SEQ ID NO: 4697 - RNA, 20 nt, Artificial Sequence
  Guide Sequence
acccaucuugguccuuuucc

SEQ ID NO: 4698 - RNA, 20 nt, Artificial Sequence
  Guide Sequence
agcccuggaggggcugaaaa

SEQ ID NO: 4699 - RNA, 20 nt, Artificial Sequence
  Guide Sequence
aggggcugaaaaugauggug

SEQ ID NO: 4700 - RNA, 20 nt, Artificial Sequence
  Guide Sequence
aucauuuucagccccuccag

SEQ ID NO: 4701 - RNA, 20 nt, Artificial Sequence
  Guide Sequence
aucuugguccuuuuccacca

SEQ ID NO: 4702 - RNA, 20 nt, Artificial Sequence
  Guide Sequence
augaugguggaaaaggacca

SEQ ID NO: 4703 - RNA, 20 nt, Artificial Sequence
  Guide Sequence
caccaucauuuucagccccu

SEQ ID NO: 4704 - RNA, 20 nt, Artificial Sequence
  Guide Sequence
caucauuuucagccccucca

SEQ ID NO: 4705 - RNA, 20 nt, Artificial Sequence
  Guide Sequence
caucuugguccuuuuccacc

SEQ ID NO: 4706 - RNA, 20 nt, Artificial Sequence
  Guide Sequence
ccaccaucauuuucagcccc

SEQ ID NO: 4707 - RNA, 20 nt, Artificial Sequence
  Guide Sequence
ccaucauuuucagccccucc

SEQ ID NO: 4708 - RNA, 20 nt, Artificial Sequence
  Guide Sequence
ccaucuugguccuuuuccac

SEQ ID NO: 4709 - RNA, 20 nt, Artificial Sequence
  Guide Sequence
cccaucuugguccuuuucca

SEQ ID NO: 4710 - RNA, 20 nt, Artificial Sequence
  Guide Sequence
cccuggaggggcugaaaaug

SEQ ID NO: 4711 - RNA, 20 nt, Artificial Sequence
  Guide Sequence
ccuggaggggcugaaaauga

SEQ ID NO: 4712 - RNA, 20 nt, Artificial Sequence
  Guide Sequence
ccuuuuccaccaucauuuuc

SEQ ID NO: 4713 - RNA, 20 nt, Artificial Sequence
  Guide Sequence
cugaaaaugaugguggaaaa

SEQ ID NO: 4714 - RNA, 20 nt, Artificial Sequence
  Guide Sequence
cuggaggggcugaaaaugau

SEQ ID NO: 4715 - RNA, 20 nt, Artificial Sequence
  Guide Sequence
cuugguccuuuuccaccauc

SEQ ID NO: 4716 - RNA, 20 nt, Artificial Sequence
  Guide Sequence
cuuuuccaccaucauuuuca

SEQ ID NO: 4717 - RNA, 20 nt, Artificial Sequence
  Guide Sequence
gaaaaugaugguggaaaagg

SEQ ID NO: 4718 - RNA, 20 nt, Artificial Sequence
  Guide Sequence
gaggggcugaaaaugauggu

SEQ ID NO: 4719 - RNA, 20 nt, Artificial Sequence
  Guide Sequence
gaugguggaaaaggaccaag

SEQ ID NO: 4720 - RNA, 20 nt, Artificial Sequence
  Guide Sequence
gcccuggaggggcugaaaau

SEQ ID NO: 4721 - RNA, 20 nt, Artificial Sequence
  Guide Sequence
gcugaaaaugaugguggaaa

SEQ ID NO: 4722 - RNA, 20 nt, Artificial Sequence
  Guide Sequence
ggaggggcugaaaaugaugg

SEQ ID NO: 4723 - RNA, 20 nt, Artificial Sequence
  Guide Sequence
ggcugaaaaugaugguggaa

SEQ ID NO: 4724 - RNA, 20 nt, Artificial Sequence
  Guide Sequence
gggcugaaaaugauggugga

SEQ ID NO: 4725 - RNA, 20 nt, Artificial Sequence
  Guide Sequence
ggggcugaaaaugauggugg

SEQ ID NO: 4726 - RNA, 20 nt, Artificial Sequence
  Guide Sequence
gguccuuuuccaccaucauu

SEQ ID NO: 4727 - RNA, 20 nt, Artificial Sequence
  Guide Sequence
gguggaaaaggaccaagaug

SEQ ID NO: 4728 - RNA, 20 nt, Artificial Sequence
  Guide Sequence
guccuuuuccaccaucauuu

SEQ ID NO: 4729 - RNA, 20 nt, Artificial Sequence
  Guide Sequence
guggaaaaggaccaagaugg

SEQ ID NO: 4730 - RNA, 20 nt, Artificial Sequence
  Guide Sequence
uacccaucuugguccuuuuc

SEQ ID NO: 4731 - RNA, 20 nt, Artificial Sequence
  Guide Sequence
uccaccaucauuuucagccc

SEQ ID NO: 4732 - RNA, 20 nt, Artificial Sequence
  Guide Sequence
uccuuuuccaccaucauuuu

SEQ ID NO: 4733 - RNA, 20 nt, Artificial Sequence
  Guide Sequence
ucuugguccuuuuccaccau

SEQ ID NO: 4734 - RNA, 20 nt, Artificial Sequence
  Guide Sequence
ugaaaaugaugguggaaaag

SEQ ID NO: 4735 - RNA, 20 nt, Artificial Sequence
  Guide Sequence
ugaugguggaaaaggaccaa

SEQ ID NO: 4736 - RNA, 20 nt, Artificial Sequence
  Guide Sequence
uggaggggcugaaaaugaug

SEQ ID NO: 4737 - RNA, 20 nt, Artificial Sequence
  Guide Sequence
ugguccuuuuccaccaucau

SEQ ID NO: 4738 - RNA, 20 nt, Artificial Sequence
  Guide Sequence
ugguggaaaaggaccaagau

SEQ ID NO: 4739 - RNA, 20 nt, Artificial Sequence
  Guide Sequence
uuacccaucuugguccuuuu

SEQ ID NO: 4740 - RNA, 20 nt, Artificial Sequence
  Guide Sequence
uuccaccaucauuuucagcc

SEQ ID NO: 4741 - RNA, 20 nt, Artificial Sequence
  Guide Sequence
uugguccuuuuccaccauca

SEQ ID NO: 4742 - RNA, 20 nt, Artificial Sequence
  Guide Sequence
uuuccaccaucauuuucagc

SEQ ID NO: 4743 - RNA, 20 nt, Artificial Sequence
  Guide Sequence
uuuuccaccaucauuuucag

SEQ ID NO: 4744 - RNA, 21 nt, Artificial Sequence
  Guide Sequence
aaaaugaugguggaaaaggac

SEQ ID NO: 4745 - RNA, 21 nt, Artificial Sequence
  Guide Sequence
aaaugaugguggaaaaggacc

SEQ ID NO: 4746 - RNA, 21 nt, Artificial Sequence
  Guide Sequence
aagcccuggaggggcugaaaa

SEQ ID NO: 4747 - RNA, 21 nt, Artificial Sequence
  Guide Sequence
aaugaugguggaaaaggacca

SEQ ID NO: 4748 - RNA, 21 nt, Artificial Sequence
  Guide Sequence
accaucauuuucagccccucc

SEQ ID NO: 4749 - RNA, 21 nt, Artificial Sequence
  Guide Sequence
acccaucuugguccuuuucca

SEQ ID NO: 4750 - RNA, 21 nt, Artificial Sequence
  Guide Sequence
agcccuggaggggcugaaaau

SEQ ID NO: 4751 - RNA, 21 nt, Artificial Sequence
  Guide Sequence
aggggcugaaaaugauggugg

SEQ ID NO: 4752 - RNA, 21 nt, Artificial Sequence
  Guide Sequence
aucauuuucagccccuccagg

SEQ ID NO: 4753 - RNA, 21 nt, Artificial Sequence
  Guide Sequence
aucuugguccuuuuccaccau

SEQ ID NO: 4754 - RNA, 21 nt, Artificial Sequence
  Guide Sequence
augaugguggaaaaggaccaa

SEQ ID NO: 4755 - RNA, 21 nt, Artificial Sequence
  Guide Sequence
caagcccuggaggggcugaaa

SEQ ID NO: 4756 - RNA, 21 nt, Artificial Sequence
  Guide Sequence
caccaucauuuucagccccuc

SEQ ID NO: 4757 - RNA, 21 nt, Artificial Sequence
  Guide Sequence
caucauuuucagccccuccag

SEQ ID NO: 4758 - RNA, 21 nt, Artificial Sequence
  Guide Sequence
caucuugguccuuuuccacca

SEQ ID NO: 4759 - RNA, 21 nt, Artificial Sequence
  Guide Sequence
ccaccaucauuuucagccccu

SEQ ID NO: 4760 - RNA, 21 nt, Artificial Sequence
  Guide Sequence
ccaucauuuucagccccucca

SEQ ID NO: 4761 - RNA, 21 nt, Artificial Sequence
  Guide Sequence
ccaucuugguccuuuuccacc

SEQ ID NO: 4762 - RNA, 21 nt, Artificial Sequence
  Guide Sequence
cccaucuugguccuuuuccac

SEQ ID NO: 4763 - RNA, 21 nt, Artificial Sequence
  Guide Sequence
cccuggaggggcugaaaauga

SEQ ID NO: 4764 - RNA, 21 nt, Artificial Sequence
  Guide Sequence
ccuggaggggcugaaaaugau

SEQ ID NO: 4765 - RNA, 21 nt, Artificial Sequence
  Guide Sequence
ccuuuuccaccaucauuuuca

SEQ ID NO: 4766 - RNA, 21 nt, Artificial Sequence
  Guide Sequence
cugaaaaugaugguggaaaag

SEQ ID NO: 4767 - RNA, 21 nt, Artificial Sequence
  Guide Sequence
cuggaggggcugaaaaugaug

SEQ ID NO: 4768 - RNA, 21 nt, Artificial Sequence
  Guide Sequence
cuuacccaucuugguccuuuu

SEQ ID NO: 4769 - RNA, 21 nt, Artificial Sequence
  Guide Sequence
cuugguccuuuuccaccauca

SEQ ID NO: 4770 - RNA, 21 nt, Artificial Sequence
  Guide Sequence
cuuuuccaccaucauuuucag

SEQ ID NO: 4771 - RNA, 21 nt, Artificial Sequence
  Guide Sequence
gaaaaugaugguggaaaagga

SEQ ID NO: 4772 - RNA, 21 nt, Artificial Sequence
  Guide Sequence
gaggggcugaaaaugauggug

SEQ ID NO: 4773 - RNA, 21 nt, Artificial Sequence
  Guide Sequence
gaugguggaaaaggaccaaga

SEQ ID NO: 4774 - RNA, 21 nt, Artificial Sequence
  Guide Sequence
gcccuggaggggcugaaaaug

SEQ ID NO: 4775 - RNA, 21 nt, Artificial Sequence
  Guide Sequence
gcugaaaaugaugguggaaaa

SEQ ID NO: 4776 - RNA, 21 nt, Artificial Sequence
  Guide Sequence
ggaggggcugaaaaugauggu

SEQ ID NO: 4777 - RNA, 21 nt, Artificial Sequence
  Guide Sequence
ggcugaaaaugaugguggaaa

SEQ ID NO: 4778 - RNA, 21 nt, Artificial Sequence
  Guide Sequence
gggcugaaaaugaugguggaa

SEQ ID NO: 4779 - RNA, 21 nt, Artificial Sequence
  Guide Sequence
ggggcugaaaaugauggugga

SEQ ID NO: 4780 - RNA, 21 nt, Artificial Sequence
  Guide Sequence
gguccuuuuccaccaucauuu

SEQ ID NO: 4781 - RNA, 21 nt, Artificial Sequence
  Guide Sequence
gguggaaaaggaccaagaugg

SEQ ID NO: 4782 - RNA, 21 nt, Artificial Sequence
  Guide Sequence
guccuuuuccaccaucauuuu

SEQ ID NO: 4783 - RNA, 21 nt, Artificial Sequence
  Guide Sequence
guggaaaaggaccaagauggg

SEQ ID NO: 4784 - RNA, 21 nt, Artificial Sequence
  Guide Sequence
uacccaucuugguccuuuucc

SEQ ID NO: 4785 - RNA, 21 nt, Artificial Sequence
  Guide Sequence
uccaccaucauuuucagcccc

SEQ ID NO: 4786 - RNA, 21 nt, Artificial Sequence
  Guide Sequence
uccuuuuccaccaucauuuuc

SEQ ID NO: 4787 - RNA, 21 nt, Artificial Sequence
  Guide Sequence
ucuugguccuuuuccaccauc

SEQ ID NO: 4788 - RNA, 21 nt, Artificial Sequence
  Guide Sequence
ugaaaaugaugguggaaaagg

SEQ ID NO: 4789 - RNA, 21 nt, Artificial Sequence
  Guide Sequence
ugaugguggaaaaggaccaag

SEQ ID NO: 4790 - RNA, 21 nt, Artificial Sequence
  Guide Sequence
uggaggggcugaaaaugaugg

SEQ ID NO: 4791 - RNA, 21 nt, Artificial Sequence
  Guide Sequence
ugguccuuuuccaccaucauu

SEQ ID NO: 4792 - RNA, 21 nt, Artificial Sequence
  Guide Sequence
ugguggaaaaggaccaagaug

SEQ ID NO: 4793 - RNA, 21 nt, Artificial Sequence
  Guide Sequence
uuacccaucuugguccuuuuc

SEQ ID NO: 4794 - RNA, 21 nt, Artificial Sequence
  Guide Sequence
uuccaccaucauuuucagccc

SEQ ID NO: 4795 - RNA, 21 nt, Artificial Sequence
  Guide Sequence
uugguccuuuuccaccaucau

SEQ ID NO: 4796 - RNA, 21 nt, Artificial Sequence
  Guide Sequence
uuuccaccaucauuuucagcc

SEQ ID NO: 4797 - RNA, 21 nt, Artificial Sequence
  Guide Sequence
uuuuccaccaucauuuucagc

SEQ ID NO: 4798 - RNA, 22 nt, Artificial Sequence
  Guide Sequence
aaaaugaugguggaaaaggacc

SEQ ID NO: 4799 - RNA, 22 nt, Artificial Sequence
  Guide Sequence
aaaugaugguggaaaaggacca

SEQ ID NO: 4800 - RNA, 22 nt, Artificial Sequence
  Guide Sequence
aagcccuggaggggcugaaaau

SEQ ID NO: 4801 - RNA, 22 nt, Artificial Sequence
  Guide Sequence
aaugaugguggaaaaggaccaa

SEQ ID NO: 4802 - RNA, 22 nt, Artificial Sequence
  Guide Sequence
accaucauuuucagccccucca

SEQ ID NO: 4803 - RNA, 22 nt, Artificial Sequence
  Guide Sequence
acccaucuugguccuuuuccac

SEQ ID NO: 4804 - RNA, 22 nt, Artificial Sequence
  Guide Sequence
agcccuggaggggcugaaaaug

SEQ ID NO: 4805 - RNA, 22 nt, Artificial Sequence
  Guide Sequence
aggggcugaaaaugauggugga

SEQ ID NO: 4806 - RNA, 22 nt, Artificial Sequence
  Guide Sequence
aucauuuucagccccuccaggg

SEQ ID NO: 4807 - RNA, 22 nt, Artificial Sequence
  Guide Sequence
aucuugguccuuuuccaccauc

SEQ ID NO: 4808 - RNA, 22 nt, Artificial Sequence
  Guide Sequence
augaugguggaaaaggaccaag

SEQ ID NO: 4809 - RNA, 22 nt, Artificial Sequence
  Guide Sequence
caagcccuggaggggcugaaaa

SEQ ID NO: 4810 - RNA, 22 nt, Artificial Sequence
  Guide Sequence
caccaucauuuucagccccucc

SEQ ID NO: 4811 - RNA, 22 nt, Artificial Sequence
  Guide Sequence
caucauuuucagccccuccagg

SEQ ID NO: 4812 - RNA, 22 nt, Artificial Sequence
  Guide Sequence
caucuugguccuuuuccaccau

SEQ ID NO: 4813 - RNA, 22 nt, Artificial Sequence
  Guide Sequence
ccaagcccuggaggggcugaaa

SEQ ID NO: 4814 - RNA, 22 nt, Artificial Sequence
  Guide Sequence
ccaccaucauuuucagccccuc

SEQ ID NO: 4815 - RNA, 22 nt, Artificial Sequence
  Guide Sequence
ccaucauuuucagccccuccag

SEQ ID NO: 4816 - RNA, 22 nt, Artificial Sequence
  Guide Sequence
ccaucuugguccuuuuccacca

SEQ ID NO: 4817 - RNA, 22 nt, Artificial Sequence
  Guide Sequence
cccaucuugguccuuuuccacc

SEQ ID NO: 4818 - RNA, 22 nt, Artificial Sequence
  Guide Sequence
cccuggaggggcugaaaaugau

SEQ ID NO: 4819 - RNA, 22 nt, Artificial Sequence
  Guide Sequence
ccuggaggggcugaaaaugaug

SEQ ID NO: 4820 - RNA, 22 nt, Artificial Sequence
  Guide Sequence
ccuuuuccaccaucauuuucag

SEQ ID NO: 4821 - RNA, 22 nt, Artificial Sequence
  Guide Sequence
cugaaaaugaugguggaaaagg

SEQ ID NO: 4822 - RNA, 22 nt, Artificial Sequence
  Guide Sequence
cuggaggggcugaaaaugaugg

SEQ ID NO: 4823 - RNA, 22 nt, Artificial Sequence
  Guide Sequence
cuuacccaucuugguccuuuuc

SEQ ID NO: 4824 - RNA, 22 nt, Artificial Sequence
  Guide Sequence
cuugguccuuuuccaccaucau

SEQ ID NO: 4825 - RNA, 22 nt, Artificial Sequence
  Guide Sequence
cuuuuccaccaucauuuucagc

SEQ ID NO: 4826 - RNA, 22 nt, Artificial Sequence
  Guide Sequence
gaaaaugaugguggaaaaggac

SEQ ID NO: 4827 - RNA, 22 nt, Artificial Sequence
  Guide Sequence
gaggggcugaaaaugauggugg

SEQ ID NO: 4828 - RNA, 22 nt, Artificial Sequence
  Guide Sequence
gaugguggaaaaggaccaagau

SEQ ID NO: 4829 - RNA, 22 nt, Artificial Sequence
  Guide Sequence
gcccuggaggggcugaaaauga

SEQ ID NO: 4830 - RNA, 22 nt, Artificial Sequence
  Guide Sequence
gcugaaaaugaugguggaaaag

SEQ ID NO: 4831 - RNA, 22 nt, Artificial Sequence
  Guide Sequence
gcuuacccaucuugguccuuuu

SEQ ID NO: 4832 - RNA, 22 nt, Artificial Sequence
  Guide Sequence
ggaggggcugaaaaugauggug

SEQ ID NO: 4833 - RNA, 22 nt, Artificial Sequence
  Guide Sequence
ggcugaaaaugaugguggaaaa

SEQ ID NO: 4834 - RNA, 22 nt, Artificial Sequence
  Guide Sequence
gggcugaaaaugaugguggaaa

SEQ ID NO: 4835 - RNA, 22 nt, Artificial Sequence
  Guide Sequence
ggggcugaaaaugaugguggaa

SEQ ID NO: 4836 - RNA, 22 nt, Artificial Sequence
  Guide Sequence
gguccuuuuccaccaucauuuu

SEQ ID NO: 4837 - RNA, 22 nt, Artificial Sequence
  Guide Sequence
gguggaaaaggaccaagauggg

SEQ ID NO: 4838 - RNA, 22 nt, Artificial Sequence
  Guide Sequence
guccuuuuccaccaucauuuuc

SEQ ID NO: 4839 - RNA, 22 nt, Artificial Sequence
  Guide Sequence
guggaaaaggaccaagaugggu

SEQ ID NO: 4840 - RNA, 22 nt, Artificial Sequence
  Guide Sequence
uacccaucuugguccuuuucca

SEQ ID NO: 4841 - RNA, 22 nt, Artificial Sequence
  Guide Sequence
uccaccaucauuuucagccccu

SEQ ID NO: 4842 - RNA, 22 nt, Artificial Sequence
  Guide Sequence
uccuuuuccaccaucauuuuca

SEQ ID NO: 4843 - RNA, 22 nt, Artificial Sequence
  Guide Sequence
ucuugguccuuuuccaccauca

SEQ ID NO: 4844 - RNA, 22 nt, Artificial Sequence
  Guide Sequence
ugaaaaugaugguggaaaagga

SEQ ID NO: 4845 - RNA, 22 nt, Artificial Sequence
  Guide Sequence
ugaugguggaaaaggaccaaga

SEQ ID NO: 4846 - RNA, 22 nt, Artificial Sequence
  Guide Sequence
uggaggggcugaaaaugauggu

SEQ ID NO: 4847 - RNA, 22 nt, Artificial Sequence
  Guide Sequence
ugguccuuuuccaccaucauuu

SEQ ID NO: 4848 - RNA, 22 nt, Artificial Sequence
  Guide Sequence
ugguggaaaaggaccaagaugg

SEQ ID NO: 4849 - RNA, 22 nt, Artificial Sequence
  Guide Sequence
uuacccaucuugguccuuuucc

SEQ ID NO: 4850 - RNA, 22 nt, Artificial Sequence
  Guide Sequence
uuccaccaucauuuucagcccc

SEQ ID NO: 4851 - RNA, 22 nt, Artificial Sequence
  Guide Sequence
uugguccuuuuccaccaucauu

SEQ ID NO: 4852 - RNA, 22 nt, Artificial Sequence
  Guide Sequence
uuuccaccaucauuuucagccc

SEQ ID NO: 4853 - RNA, 22 nt, Artificial Sequence
  Guide Sequence
uuuuccaccaucauuuucagcc

SEQ ID NO: 4854 - RNA, 20 nt, Artificial Sequence
  Guide Sequence
aaaaggaccaagauggguca

SEQ ID NO: 4855 - RNA, 20 nt, Artificial Sequence
  Guide Sequence
aaaggaccaagaugggucag

SEQ ID NO: 4856 - RNA, 20 nt, Artificial Sequence
  Guide Sequence
aagaugggucagcaggguag

SEQ ID NO: 4857 - RNA, 20 nt, Artificial Sequence
  Guide Sequence
aaggaccaagaugggucagc

SEQ ID NO: 4858 - RNA, 20 nt, Artificial Sequence
  Guide Sequence
aaugcagcccccucuacccu

SEQ ID NO: 4859 - RNA, 20 nt, Artificial Sequence
  Guide Sequence
accaagaugggucagcaggg

SEQ ID NO: 4860 - RNA, 20 nt, Artificial Sequence
  Guide Sequence
acccugcugacccaucuugg

SEQ ID NO: 4861 - RNA, 20 nt, Artificial Sequence
  Guide Sequence
agaugggucagcaggguaga

SEQ ID NO: 4862 - RNA, 20 nt, Artificial Sequence
  Guide Sequence
agcccccucuacccugcuga

SEQ ID NO: 4863 - RNA, 20 nt, Artificial Sequence
  Guide Sequence
aggaccaagaugggucagca

SEQ ID NO: 4864 - RNA, 20 nt, Artificial Sequence
  Guide Sequence
augcagcccccucuacccug

SEQ ID NO: 4865 - RNA, 20 nt, Artificial Sequence
  Guide Sequence
augggucagcaggguagagg

SEQ ID NO: 4866 - RNA, 20 nt, Artificial Sequence
  Guide Sequence
caagaugggucagcagggua

SEQ ID NO: 4867 - RNA, 20 nt, Artificial Sequence
  Guide Sequence
cagcccccucuacccugcug

SEQ ID NO: 4868 - RNA, 20 nt, Artificial Sequence
  Guide Sequence
ccaagaugggucagcagggu

SEQ ID NO: 4869 - RNA, 20 nt, Artificial Sequence
  Guide Sequence
cccccucuacccugcugacc

SEQ ID NO: 4870 - RNA, 20 nt, Artificial Sequence
  Guide Sequence
ccccucuacccugcugaccc

SEQ ID NO: 4871 - RNA, 20 nt, Artificial Sequence
  Guide Sequence
cccucuacccugcugaccca

SEQ ID NO: 4872 - RNA, 20 nt, Artificial Sequence
  Guide Sequence
cccugcugacccaucuuggu

SEQ ID NO: 4873 - RNA, 20 nt, Artificial Sequence
  Guide Sequence
ccucuacccugcugacccau

SEQ ID NO: 4874 - RNA, 20 nt, Artificial Sequence
  Guide Sequence
ccugcugacccaucuugguc

SEQ ID NO: 4875 - RNA, 20 nt, Artificial Sequence
  Guide Sequence
cuacccugcugacccaucuu

SEQ ID NO: 4876 - RNA, 20 nt, Artificial Sequence
  Guide Sequence
cucuacccugcugacccauc

SEQ ID NO: 4877 - RNA, 20 nt, Artificial Sequence
  Guide Sequence
cugacccaucuugguccuuu

SEQ ID NO: 4878 - RNA, 20 nt, Artificial Sequence
  Guide Sequence
cugcugacccaucuuggucc

SEQ ID NO: 4879 - RNA, 20 nt, Artificial Sequence
  Guide Sequence
gaaaaggaccaagauggguc

SEQ ID NO: 4880 - RNA, 20 nt, Artificial Sequence
  Guide Sequence
gaccaagaugggucagcagg

SEQ ID NO: 4881 - RNA, 20 nt, Artificial Sequence
  Guide Sequence
gaugggucagcaggguagag

SEQ ID NO: 4882 - RNA, 20 nt, Artificial Sequence
  Guide Sequence
gcagcccccucuacccugcu

SEQ ID NO: 4883 - RNA, 20 nt, Artificial Sequence
  Guide Sequence
gcccccucuacccugcugac

SEQ ID NO: 4884 - RNA, 20 nt, Artificial Sequence
  Guide Sequence
gcugacccaucuugguccuu

SEQ ID NO: 4885 - RNA, 20 nt, Artificial Sequence
  Guide Sequence
ggaaaaggaccaagaugggu

SEQ ID NO: 4886 - RNA, 20 nt, Artificial Sequence
  Guide Sequence
ggaccaagaugggucagcag

SEQ ID NO: 4887 - RNA, 20 nt, Artificial Sequence
  Guide Sequence
gggucagcaggguagagggg

SEQ ID NO: 4888 - RNA, 20 nt, Artificial Sequence
  Guide Sequence
ggucagcaggguagaggggg

SEQ ID NO: 4889 - RNA, 20 nt, Artificial Sequence
  Guide Sequence
gucagcaggguagagggggc

SEQ ID NO: 4890 - RNA, 20 nt, Artificial Sequence
  Guide Sequence
uacccugcugacccaucuug

SEQ ID NO: 4891 - RNA, 20 nt, Artificial Sequence
  Guide Sequence
ucagcaggguagagggggcu

SEQ ID NO: 4892 - RNA, 20 nt, Artificial Sequence
  Guide Sequence
ucuacccugcugacccaucu

SEQ ID NO: 4893 - RNA, 20 nt, Artificial Sequence
  Guide Sequence
ugacccaucuugguccuuuu

SEQ ID NO: 4894 - RNA, 20 nt, Artificial Sequence
  Guide Sequence
ugcagcccccucuacccugc

SEQ ID NO: 4895 - RNA, 20 nt, Artificial Sequence
  Guide Sequence
ugcugacccaucuugguccu

SEQ ID NO: 4896 - RNA, 20 nt, Artificial Sequence
  Guide Sequence
uggaaaaggaccaagauggg

SEQ ID NO: 4897 - RNA, 20 nt, Artificial Sequence
  Guide Sequence
ugggucagcaggguagaggg

SEQ ID NO: 4898 - RNA, 21 nt, Artificial Sequence
  Guide Sequence
aaaaggaccaagaugggucag

SEQ ID NO: 4899 - RNA, 21 nt, Artificial Sequence
  Guide Sequence
aaaggaccaagaugggucagc

SEQ ID NO: 4900 - RNA, 21 nt, Artificial Sequence
  Guide Sequence
aagaugggucagcaggguaga

SEQ ID NO: 4901 - RNA, 21 nt, Artificial Sequence
  Guide Sequence
aaggaccaagaugggucagca

SEQ ID NO: 4902 - RNA, 21 nt, Artificial Sequence
  Guide Sequence
aaugcagcccccucuacccug

SEQ ID NO: 4903 - RNA, 21 nt, Artificial Sequence
  Guide Sequence
accaagaugggucagcagggu

SEQ ID NO: 4904 - RNA, 21 nt, Artificial Sequence
  Guide Sequence
acccugcugacccaucuuggu

SEQ ID NO: 4905 - RNA, 21 nt, Artificial Sequence
  Guide Sequence
agaugggucagcaggguagag

SEQ ID NO: 4906 - RNA, 21 nt, Artificial Sequence
  Guide Sequence
agcccccucuacccugcugac

SEQ ID NO: 4907 - RNA, 21 nt, Artificial Sequence
  Guide Sequence
aggaccaagaugggucagcag

SEQ ID NO: 4908 - RNA, 21 nt, Artificial Sequence
  Guide Sequence
augcagcccccucuacccugc

SEQ ID NO: 4909 - RNA, 21 nt, Artificial Sequence
  Guide Sequence
augggucagcaggguagaggg

SEQ ID NO: 4910 - RNA, 21 nt, Artificial Sequence
  Guide Sequence
caagaugggucagcaggguag

SEQ ID NO: 4911 - RNA, 21 nt, Artificial Sequence
  Guide Sequence
caaugcagcccccucuacccu

SEQ ID NO: 4912 - RNA, 21 nt, Artificial Sequence
  Guide Sequence
cagcccccucuacccugcuga

SEQ ID NO: 4913 - RNA, 21 nt, Artificial Sequence
  Guide Sequence
ccaagaugggucagcagggua

SEQ ID NO: 4914 - RNA, 21 nt, Artificial Sequence
  Guide Sequence
cccccucuacccugcugaccc

SEQ ID NO: 4915 - RNA, 21 nt, Artificial Sequence
  Guide Sequence
ccccucuacccugcugaccca

SEQ ID NO: 4916 - RNA, 21 nt, Artificial Sequence
  Guide Sequence
cccucuacccugcugacccau

SEQ ID NO: 4917 - RNA, 21 nt, Artificial Sequence
  Guide Sequence
cccugcugacccaucuugguc

SEQ ID NO: 4918 - RNA, 21 nt, Artificial Sequence
  Guide Sequence
ccucuacccugcugacccauc

SEQ ID NO: 4919 - RNA, 21 nt, Artificial Sequence
  Guide Sequence
ccugcugacccaucuuggucc

SEQ ID NO: 4920 - RNA, 21 nt, Artificial Sequence
  Guide Sequence
cuacccugcugacccaucuug

SEQ ID NO: 4921 - RNA, 21 nt, Artificial Sequence
  Guide Sequence
cucuacccugcugacccaucu

SEQ ID NO: 4922 - RNA, 21 nt, Artificial Sequence
  Guide Sequence
cugacccaucuugguccuuuu

SEQ ID NO: 4923 - RNA, 21 nt, Artificial Sequence
  Guide Sequence
cugcugacccaucuugguccu

SEQ ID NO: 4924 - RNA, 21 nt, Artificial Sequence
  Guide Sequence
gaaaaggaccaagauggguca

SEQ ID NO: 4925 - RNA, 21 nt, Artificial Sequence
  Guide Sequence
gaccaagaugggucagcaggg

SEQ ID NO: 4926 - RNA, 21 nt, Artificial Sequence
  Guide Sequence
gaugggucagcaggguagagg

SEQ ID NO: 4927 - RNA, 21 nt, Artificial Sequence
  Guide Sequence
gcagcccccucuacccugcug

SEQ ID NO: 4928 - RNA, 21 nt, Artificial Sequence
  Guide Sequence
gcccccucuacccugcugacc

SEQ ID NO: 4929 - RNA, 21 nt, Artificial Sequence
  Guide Sequence
gcugacccaucuugguccuuu

SEQ ID NO: 4930 - RNA, 21 nt, Artificial Sequence
  Guide Sequence
ggaaaaggaccaagauggguc

SEQ ID NO: 4931 - RNA, 21 nt, Artificial Sequence
  Guide Sequence
ggaccaagaugggucagcagg

SEQ ID NO: 4932 - RNA, 21 nt, Artificial Sequence
  Guide Sequence
gggucagcaggguagaggggg

SEQ ID NO: 4933 - RNA, 21 nt, Artificial Sequence
  Guide Sequence
ggucagcaggguagagggggc

SEQ ID NO: 4934 - RNA, 21 nt, Artificial Sequence
  Guide Sequence
gucagcaggguagagggggcu

SEQ ID NO: 4935 - RNA, 21 nt, Artificial Sequence
  Guide Sequence
uacccugcugacccaucuugg

SEQ ID NO: 4936 - RNA, 21 nt, Artificial Sequence
  Guide Sequence
ucagcaggguagagggggcug

SEQ ID NO: 4937 - RNA, 21 nt, Artificial Sequence
  Guide Sequence
ucuacccugcugacccaucuu

SEQ ID NO: 4938 - RNA, 21 nt, Artificial Sequence
  Guide Sequence
ugacccaucuugguccuuuuc

SEQ ID NO: 4939 - RNA, 21 nt, Artificial Sequence
  Guide Sequence
ugcagcccccucuacccugcu

SEQ ID NO: 4940 - RNA, 21 nt, Artificial Sequence
  Guide Sequence
ugcugacccaucuugguccuu

SEQ ID NO: 4941 - RNA, 21 nt, Artificial Sequence
  Guide Sequence
uggaaaaggaccaagaugggu

SEQ ID NO: 4942 - RNA, 21 nt, Artificial Sequence
  Guide Sequence
ugggucagcaggguagagggg

SEQ ID NO: 4943 - RNA, 22 nt, Artificial Sequence
  Guide Sequence
aaaaggaccaagaugggucagc

SEQ ID NO: 4944 - RNA, 22 nt, Artificial Sequence
  Guide Sequence
aaaggaccaagaugggucagca

SEQ ID NO: 4945 - RNA, 22 nt, Artificial Sequence
  Guide Sequence
aagaugggucagcaggguagag

SEQ ID NO: 4946 - RNA, 22 nt, Artificial Sequence
  Guide Sequence
aaggaccaagaugggucagcag

SEQ ID NO: 4947 - RNA, 22 nt, Artificial Sequence
  Guide Sequence
aaugcagcccccucuacccugc

SEQ ID NO: 4948 - RNA, 22 nt, Artificial Sequence
  Guide Sequence
accaagaugggucagcagggua

SEQ ID NO: 4949 - RNA, 22 nt, Artificial Sequence
  Guide Sequence
acccugcugacccaucuugguc

SEQ ID NO: 4950 - RNA, 22 nt, Artificial Sequence
  Guide Sequence
agaugggucagcaggguagagg

SEQ ID NO: 4951 - RNA, 22 nt, Artificial Sequence
  Guide Sequence
agcccccucuacccugcugacc

SEQ ID NO: 4952 - RNA, 22 nt, Artificial Sequence
  Guide Sequence
aggaccaagaugggucagcagg

SEQ ID NO: 4953 - RNA, 22 nt, Artificial Sequence
  Guide Sequence
augcagcccccucuacccugcu

SEQ ID NO: 4954 - RNA, 22 nt, Artificial Sequence
  Guide Sequence
augggucagcaggguagagggg

SEQ ID NO: 4955 - RNA, 22 nt, Artificial Sequence
  Guide Sequence
augguggaaaaggaccaagaug

SEQ ID NO: 4956 - RNA, 22 nt, Artificial Sequence
  Guide Sequence
caagaugggucagcaggguaga

SEQ ID NO: 4957 - RNA, 22 nt, Artificial Sequence
  Guide Sequence
caaugcagcccccucuacccug

SEQ ID NO: 4958 - RNA, 22 nt, Artificial Sequence
  Guide Sequence
cagcccccucuacccugcugac

SEQ ID NO: 4959 - RNA, 22 nt, Artificial Sequence
  Guide Sequence
ccaagaugggucagcaggguag

SEQ ID NO: 4960 - RNA, 22 nt, Artificial Sequence
  Guide Sequence
cccccucuacccugcugaccca

SEQ ID NO: 4961 - RNA, 22 nt, Artificial Sequence
  Guide Sequence
ccccucuacccugcugacccau

SEQ ID NO: 4962 - RNA, 22 nt, Artificial Sequence
  Guide Sequence
cccucuacccugcugacccauc

SEQ ID NO: 4963 - RNA, 22 nt, Artificial Sequence
  Guide Sequence
cccugcugacccaucuuggucc

SEQ ID NO: 4964 - RNA, 22 nt, Artificial Sequence
  Guide Sequence
ccucuacccugcugacccaucu

SEQ ID NO: 4965 - RNA, 22 nt, Artificial Sequence
  Guide Sequence
ccugcugacccaucuugguccu

SEQ ID NO: 4966 - RNA, 22 nt, Artificial Sequence
  Guide Sequence
cuacccugcugacccaucuugg

SEQ ID NO: 4967 - RNA, 22 nt, Artificial Sequence
  Guide Sequence
cucuacccugcugacccaucuu

SEQ ID NO: 4968 - RNA, 22 nt, Artificial Sequence
  Guide Sequence
cugacccaucuugguccuuuuc

SEQ ID NO: 4969 - RNA, 22 nt, Artificial Sequence
  Guide Sequence
cugcugacccaucuugguccuu

SEQ ID NO: 4970 - RNA, 22 nt, Artificial Sequence
  Guide Sequence
gaaaaggaccaagaugggucag

SEQ ID NO: 4971 - RNA, 22 nt, Artificial Sequence
  Guide Sequence
gaccaagaugggucagcagggu

SEQ ID NO: 4972 - RNA, 22 nt, Artificial Sequence
  Guide Sequence
gaugggucagcaggguagaggg

SEQ ID NO: 4973 - RNA, 22 nt, Artificial Sequence
  Guide Sequence
gcagcccccucuacccugcuga

SEQ ID NO: 4974 - RNA, 22 nt, Artificial Sequence
  Guide Sequence
gcccccucuacccugcugaccc

SEQ ID NO: 4975 - RNA, 22 nt, Artificial Sequence
  Guide Sequence
gcugacccaucuugguccuuuu

SEQ ID NO: 4976 - RNA, 22 nt, Artificial Sequence
  Guide Sequence
ggaaaaggaccaagauggguca

SEQ ID NO: 4977 - RNA, 22 nt, Artificial Sequence
  Guide Sequence
ggaccaagaugggucagcaggg

SEQ ID NO: 4978 - RNA, 22 nt, Artificial Sequence
  Guide Sequence
gggucagcaggguagagggggc

SEQ ID NO: 4979 - RNA, 22 nt, Artificial Sequence
  Guide Sequence
ggucagcaggguagagggggcu

SEQ ID NO: 4980 - RNA, 22 nt, Artificial Sequence
  Guide Sequence
gucagcaggguagagggggcug

SEQ ID NO: 4981 - RNA, 22 nt, Artificial Sequence
  Guide Sequence
uacccugcugacccaucuuggu

SEQ ID NO: 4982 - RNA, 22 nt, Artificial Sequence
  Guide Sequence
ucaaugcagcccccucuacccu

SEQ ID NO: 4983 - RNA, 22 nt, Artificial Sequence
  Guide Sequence
ucagcaggguagagggggcugc

SEQ ID NO: 4984 - RNA, 22 nt, Artificial Sequence
  Guide Sequence
ucuacccugcugacccaucuug

SEQ ID NO: 4985 - RNA, 22 nt, Artificial Sequence
  Guide Sequence
ugacccaucuugguccuuuucc

SEQ ID NO: 4986 - RNA, 22 nt, Artificial Sequence
  Guide Sequence
ugcagcccccucuacccugcug

SEQ ID NO: 4987 - RNA, 22 nt, Artificial Sequence
  Guide Sequence
ugcugacccaucuugguccuuu

SEQ ID NO: 4988 - RNA, 22 nt, Artificial Sequence
  Guide Sequence
uggaaaaggaccaagauggguc

SEQ ID NO: 4989 - RNA, 22 nt, Artificial Sequence
  Guide Sequence
ugggucagcaggguagaggggg

SEQ ID NO: 4990 - RNA, 20 nt, Artificial Sequence
  Guide Sequence
aaacacugacaccucaggga

SEQ ID NO: 4991 - RNA, 20 nt, Artificial Sequence
  Guide Sequence
aacacugacaccucagggac

SEQ ID NO: 4992 - RNA, 20 nt, Artificial Sequence
  Guide Sequence
acacugacaccucagggaca

SEQ ID NO: 4993 - RNA, 20 nt, Artificial Sequence
  Guide Sequence
acagcggccgcaaacacuga

SEQ ID NO: 4994 - RNA, 20 nt, Artificial Sequence
  Guide Sequence
agcggccgcaaacacugaca

SEQ ID NO: 4995 - RNA, 20 nt, Artificial Sequence
  Guide Sequence
aggugucaguguuugcggcc

SEQ ID NO: 4996 - RNA, 20 nt, Artificial Sequence
  Guide Sequence
aguguuugcggccgcugugg

SEQ ID NO: 4997 - RNA, 20 nt, Artificial Sequence
  Guide Sequence
aucucuuugucccugaggug

SEQ ID NO: 4998 - RNA, 20 nt, Artificial Sequence
  Guide Sequence
caaacacugacaccucaggg

SEQ ID NO: 4999 - RNA, 20 nt, Artificial Sequence
  Guide Sequence
cacagcggccgcaaacacug

SEQ ID NO: 5000 - RNA, 20 nt, Artificial Sequence
  Guide Sequence
cacugacaccucagggacaa

SEQ ID NO: 5001 - RNA, 20 nt, Artificial Sequence
  Guide Sequence
cagcggccgcaaacacugac

SEQ ID NO: 5002 - RNA, 20 nt, Artificial Sequence
  Guide Sequence
caguguuugcggccgcugug

SEQ ID NO: 5003 - RNA, 20 nt, Artificial Sequence
  Guide Sequence
ccacagcggccgcaaacacu

SEQ ID NO: 5004 - RNA, 20 nt, Artificial Sequence
  Guide Sequence
cccacagcggccgcaaacac

SEQ ID NO: 5005 - RNA, 20 nt, Artificial Sequence
  Guide Sequence
ccccacagcggccgcaaaca

SEQ ID NO: 5006 - RNA, 20 nt, Artificial Sequence
  Guide Sequence
cccuccccacagcggccgca

SEQ ID NO: 5007 - RNA, 20 nt, Artificial Sequence
  Guide Sequence
cccugaggugucaguguuug

SEQ ID NO: 5008 - RNA, 20 nt, Artificial Sequence
  Guide Sequence
ccgcaaacacugacaccuca

SEQ ID NO: 5009 - RNA, 20 nt, Artificial Sequence
  Guide Sequence
ccuccccacagcggccgcaa

SEQ ID NO: 5010 - RNA, 20 nt, Artificial Sequence
  Guide Sequence
ccugaggugucaguguuugc

SEQ ID NO: 5011 - RNA, 20 nt, Artificial Sequence
  Guide Sequence
cgcaaacacugacaccucag

SEQ ID NO: 5012 - RNA, 20 nt, Artificial Sequence
  Guide Sequence
cggccgcaaacacugacacc

SEQ ID NO: 5013 - RNA, 20 nt, Artificial Sequence
  Guide Sequence
cuccccacagcggccgcaaa

SEQ ID NO: 5014 - RNA, 20 nt, Artificial Sequence
  Guide Sequence
cucuuugucccugagguguc

SEQ ID NO: 5015 - RNA, 20 nt, Artificial Sequence
  Guide Sequence
cugacaccucagggacaaag

SEQ ID NO: 5016 - RNA, 20 nt, Artificial Sequence
  Guide Sequence
cugaggugucaguguuugcg

SEQ ID NO: 5017 - RNA, 20 nt, Artificial Sequence
  Guide Sequence
cuuugucccugaggugucag

SEQ ID NO: 5018 - RNA, 20 nt, Artificial Sequence
  Guide Sequence
gaggugucaguguuugcggc

SEQ ID NO: 5019 - RNA, 20 nt, Artificial Sequence
  Guide Sequence
gaucucuuugucccugaggu

SEQ ID NO: 5020 - RNA, 20 nt, Artificial Sequence
  Guide Sequence
gcaaacacugacaccucagg

SEQ ID NO: 5021 - RNA, 20 nt, Artificial Sequence
  Guide Sequence
gccgcaaacacugacaccuc

SEQ ID NO: 5022 - RNA, 20 nt, Artificial Sequence
  Guide Sequence
gcggccgcaaacacugacac

SEQ ID NO: 5023 - RNA, 20 nt, Artificial Sequence
  Guide Sequence
ggccgcaaacacugacaccu

SEQ ID NO: 5024 - RNA, 20 nt, Artificial Sequence
  Guide Sequence
ggugucaguguuugcggccg

SEQ ID NO: 5025 - RNA, 20 nt, Artificial Sequence
  Guide Sequence
gucaguguuugcggccgcug

SEQ ID NO: 5026 - RNA, 20 nt, Artificial Sequence
  Guide Sequence
gucccugaggugucaguguu

SEQ ID NO: 5027 - RNA, 20 nt, Artificial Sequence
  Guide Sequence
gugucaguguuugcggccgc

SEQ ID NO: 5028 - RNA, 20 nt, Artificial Sequence
  Guide Sequence
guguuugcggccgcuguggg

SEQ ID NO: 5029 - RNA, 20 nt, Artificial Sequence
  Guide Sequence
ucaguguuugcggccgcugu

SEQ ID NO: 5030 - RNA, 20 nt, Artificial Sequence
  Guide Sequence
uccccacagcggccgcaaac

SEQ ID NO: 5031 - RNA, 20 nt, Artificial Sequence
  Guide Sequence
ucccugaggugucaguguuu

SEQ ID NO: 5032 - RNA, 20 nt, Artificial Sequence
  Guide Sequence
ucucuuugucccugaggugu

SEQ ID NO: 5033 - RNA, 20 nt, Artificial Sequence
  Guide Sequence
ucuuugucccugagguguca

SEQ ID NO: 5034 - RNA, 20 nt, Artificial Sequence
  Guide Sequence
ugacaccucagggacaaaga

SEQ ID NO: 5035 - RNA, 20 nt, Artificial Sequence
  Guide Sequence
ugaggugucaguguuugcgg

SEQ ID NO: 5036 - RNA, 20 nt, Artificial Sequence
  Guide Sequence
ugucaguguuugcggccgcu

SEQ ID NO: 5037 - RNA, 20 nt, Artificial Sequence
  Guide Sequence
ugucccugaggugucagugu

SEQ ID NO: 5038 - RNA, 20 nt, Artificial Sequence
  Guide Sequence
uugucccugaggugucagug

SEQ ID NO: 5039 - RNA, 20 nt, Artificial Sequence
  Guide Sequence
uuugucccugaggugucagu

SEQ ID NO: 5040 - RNA, 21 nt, Artificial Sequence
  Guide Sequence
aaacacugacaccucagggac

SEQ ID NO: 5041 - RNA, 21 nt, Artificial Sequence
  Guide Sequence
aacacugacaccucagggaca

SEQ ID NO: 5042 - RNA, 21 nt, Artificial Sequence
  Guide Sequence
acacugacaccucagggacaa

SEQ ID NO: 5043 - RNA, 21 nt, Artificial Sequence
  Guide Sequence
acagcggccgcaaacacugac

SEQ ID NO: 5044 - RNA, 21 nt, Artificial Sequence
  Guide Sequence
agaucucuuugucccugaggu

SEQ ID NO: 5045 - RNA, 21 nt, Artificial Sequence
  Guide Sequence
agcggccgcaaacacugacac

SEQ ID NO: 5046 - RNA, 21 nt, Artificial Sequence
  Guide Sequence
aggugucaguguuugcggccg

SEQ ID NO: 5047 - RNA, 21 nt, Artificial Sequence
  Guide Sequence
aguguuugcggccgcuguggg

SEQ ID NO: 5048 - RNA, 21 nt, Artificial Sequence
  Guide Sequence
aucucuuugucccugaggugu

SEQ ID NO: 5049 - RNA, 21 nt, Artificial Sequence
  Guide Sequence
caaacacugacaccucaggga

SEQ ID NO: 5050 - RNA, 21 nt, Artificial Sequence
  Guide Sequence
cacagcggccgcaaacacuga

SEQ ID NO: 5051 - RNA, 21 nt, Artificial Sequence
  Guide Sequence
cacugacaccucagggacaaa

SEQ ID NO: 5052 - RNA, 21 nt, Artificial Sequence
  Guide Sequence
cagcggccgcaaacacugaca

SEQ ID NO: 5053 - RNA, 21 nt, Artificial Sequence
  Guide Sequence
caguguuugcggccgcugugg

SEQ ID NO: 5054 - RNA, 21 nt, Artificial Sequence
  Guide Sequence
ccacagcggccgcaaacacug

SEQ ID NO: 5055 - RNA, 21 nt, Artificial Sequence
  Guide Sequence
cccacagcggccgcaaacacu

SEQ ID NO: 5056 - RNA, 21 nt, Artificial Sequence
  Guide Sequence
ccccacagcggccgcaaacac

SEQ ID NO: 5057 - RNA, 21 nt, Artificial Sequence
  Guide Sequence
cccuccccacagcggccgcaa

SEQ ID NO: 5058 - RNA, 21 nt, Artificial Sequence
  Guide Sequence
cccugaggugucaguguuugc

SEQ ID NO: 5059 - RNA, 21 nt, Artificial Sequence
  Guide Sequence
ccgcaaacacugacaccucag

SEQ ID NO: 5060 - RNA, 21 nt, Artificial Sequence
  Guide Sequence
ccuccccacagcggccgcaaa

SEQ ID NO: 5061 - RNA, 21 nt, Artificial Sequence
  Guide Sequence
ccugaggugucaguguuugcg

SEQ ID NO: 5062 - RNA, 21 nt, Artificial Sequence
  Guide Sequence
cgcaaacacugacaccucagg

SEQ ID NO: 5063 - RNA, 21 nt, Artificial Sequence
  Guide Sequence
cggccgcaaacacugacaccu

SEQ ID NO: 5064 - RNA, 21 nt, Artificial Sequence
  Guide Sequence
cuccccacagcggccgcaaac

SEQ ID NO: 5065 - RNA, 21 nt, Artificial Sequence
  Guide Sequence
cucuuugucccugagguguca

SEQ ID NO: 5066 - RNA, 21 nt, Artificial Sequence
  Guide Sequence
cugacaccucagggacaaaga

SEQ ID NO: 5067 - RNA, 21 nt, Artificial Sequence
  Guide Sequence
cugaggugucaguguuugcgg

SEQ ID NO: 5068 - RNA, 21 nt, Artificial Sequence
  Guide Sequence
cuuugucccugaggugucagu

SEQ ID NO: 5069 - RNA, 21 nt, Artificial Sequence
  Guide Sequence
gaggugucaguguuugcggcc

SEQ ID NO: 5070 - RNA, 21 nt, Artificial Sequence
  Guide Sequence
gaucucuuugucccugaggug

SEQ ID NO: 5071 - RNA, 21 nt, Artificial Sequence
  Guide Sequence
gcaaacacugacaccucaggg

SEQ ID NO: 5072 - RNA, 21 nt, Artificial Sequence
  Guide Sequence
gccgcaaacacugacaccuca

SEQ ID NO: 5073 - RNA, 21 nt, Artificial Sequence
  Guide Sequence
gcggccgcaaacacugacacc

SEQ ID NO: 5074 - RNA, 21 nt, Artificial Sequence
  Guide Sequence
ggccgcaaacacugacaccuc

SEQ ID NO: 5075 - RNA, 21 nt, Artificial Sequence
  Guide Sequence
ggugucaguguuugcggccgc

SEQ ID NO: 5076 - RNA, 21 nt, Artificial Sequence
  Guide Sequence
gucaguguuugcggccgcugu

SEQ ID NO: 5077 - RNA, 21 nt, Artificial Sequence
  Guide Sequence
gucccugaggugucaguguuu

SEQ ID NO: 5078 - RNA, 21 nt, Artificial Sequence
  Guide Sequence
gugucaguguuugcggccgcu

SEQ ID NO: 5079 - RNA, 21 nt, Artificial Sequence
  Guide Sequence
guguuugcggccgcugugggg

SEQ ID NO: 5080 - RNA, 21 nt, Artificial Sequence
  Guide Sequence
ucaguguuugcggccgcugug

SEQ ID NO: 5081 - RNA, 21 nt, Artificial Sequence
  Guide Sequence
uccccacagcggccgcaaaca

SEQ ID NO: 5082 - RNA, 21 nt, Artificial Sequence
  Guide Sequence
ucccuccccacagcggccgca

SEQ ID NO: 5083 - RNA, 21 nt, Artificial Sequence
  Guide Sequence
ucccugaggugucaguguuug

SEQ ID NO: 5084 - RNA, 21 nt, Artificial Sequence
  Guide Sequence
ucucuuugucccugagguguc

SEQ ID NO: 5085 - RNA, 21 nt, Artificial Sequence
  Guide Sequence
ucuuugucccugaggugucag

SEQ ID NO: 5086 - RNA, 21 nt, Artificial Sequence
  Guide Sequence
ugacaccucagggacaaagag

SEQ ID NO: 5087 - RNA, 21 nt, Artificial Sequence
  Guide Sequence
ugaggugucaguguuugcggc

SEQ ID NO: 5088 - RNA, 21 nt, Artificial Sequence
  Guide Sequence
ugucaguguuugcggccgcug

SEQ ID NO: 5089 - RNA, 21 nt, Artificial Sequence
  Guide Sequence
ugucccugaggugucaguguu

SEQ ID NO: 5090 - RNA, 21 nt, Artificial Sequence
  Guide Sequence
uugucccugaggugucagugu

SEQ ID NO: 5091 - RNA, 21 nt, Artificial Sequence
  Guide Sequence
uuugucccugaggugucagug

SEQ ID NO: 5092 - RNA, 22 nt, Artificial Sequence
  Guide Sequence
aaacacugacaccucagggaca

SEQ ID NO: 5093 - RNA, 22 nt, Artificial Sequence
  Guide Sequence
aacacugacaccucagggacaa

SEQ ID NO: 5094 - RNA, 22 nt, Artificial Sequence
  Guide Sequence
acacugacaccucagggacaaa

SEQ ID NO: 5095 - RNA, 22 nt, Artificial Sequence
  Guide Sequence
acagcggccgcaaacacugaca

SEQ ID NO: 5096 - RNA, 22 nt, Artificial Sequence
  Guide Sequence
agaucucuuugucccugaggug

SEQ ID NO: 5097 - RNA, 22 nt, Artificial Sequence
  Guide Sequence
agcggccgcaaacacugacacc

SEQ ID NO: 5098 - RNA, 22 nt, Artificial Sequence
  Guide Sequence
aggugucaguguuugcggccgc

SEQ ID NO: 5099 - RNA, 22 nt, Artificial Sequence
  Guide Sequence
aguguuugcggccgcugugggg

SEQ ID NO: 5100 - RNA, 22 nt, Artificial Sequence
  Guide Sequence
aucucuuugucccugagguguc

SEQ ID NO: 5101 - RNA, 22 nt, Artificial Sequence
  Guide Sequence
caaacacugacaccucagggac

SEQ ID NO: 5102 - RNA, 22 nt, Artificial Sequence
  Guide Sequence
cacagcggccgcaaacacugac

SEQ ID NO: 5103 - RNA, 22 nt, Artificial Sequence
  Guide Sequence
cacugacaccucagggacaaag

SEQ ID NO: 5104 - RNA, 22 nt, Artificial Sequence
  Guide Sequence
cagaucucuuugucccugaggu

SEQ ID NO: 5105 - RNA, 22 nt, Artificial Sequence
  Guide Sequence
cagcggccgcaaacacugacac

SEQ ID NO: 5106 - RNA, 22 nt, Artificial Sequence
  Guide Sequence
caguguuugcggccgcuguggg

SEQ ID NO: 5107 - RNA, 22 nt, Artificial Sequence
  Guide Sequence
ccacagcggccgcaaacacuga

SEQ ID NO: 5108 - RNA, 22 nt, Artificial Sequence
  Guide Sequence
cccacagcggccgcaaacacug

SEQ ID NO: 5109 - RNA, 22 nt, Artificial Sequence
  Guide Sequence
ccccacagcggccgcaaacacu

SEQ ID NO: 5110 - RNA, 22 nt, Artificial Sequence
  Guide Sequence
cccuccccacagcggccgcaaa

SEQ ID NO: 5111 - RNA, 22 nt, Artificial Sequence
  Guide Sequence
cccugaggugucaguguuugcg

SEQ ID NO: 5112 - RNA, 22 nt, Artificial Sequence
  Guide Sequence
ccgcaaacacugacaccucagg

SEQ ID NO: 5113 - RNA, 22 nt, Artificial Sequence
  Guide Sequence
ccuccccacagcggccgcaaac

SEQ ID NO: 5114 - RNA, 22 nt, Artificial Sequence
  Guide Sequence
ccugaggugucaguguuugcgg

SEQ ID NO: 5115 - RNA, 22 nt, Artificial Sequence
  Guide Sequence
cgcaaacacugacaccucaggg

SEQ ID NO: 5116 - RNA, 22 nt, Artificial Sequence
  Guide Sequence
cggccgcaaacacugacaccuc

SEQ ID NO: 5117 - RNA, 22 nt, Artificial Sequence
  Guide Sequence
cuccccacagcggccgcaaaca

SEQ ID NO: 5118 - RNA, 22 nt, Artificial Sequence
  Guide Sequence
cucuuugucccugaggugucag

SEQ ID NO: 5119 - RNA, 22 nt, Artificial Sequence
  Guide Sequence
cugacaccucagggacaaagag

SEQ ID NO: 5120 - RNA, 22 nt, Artificial Sequence
  Guide Sequence
cugaggugucaguguuugcggc

SEQ ID NO: 5121 - RNA, 22 nt, Artificial Sequence
  Guide Sequence
cuuugucccugaggugucagug

SEQ ID NO: 5122 - RNA, 22 nt, Artificial Sequence
  Guide Sequence
gaggugucaguguuugcggccg

SEQ ID NO: 5123 - RNA, 22 nt, Artificial Sequence
  Guide Sequence
gaucucuuugucccugaggugu

SEQ ID NO: 5124 - RNA, 22 nt, Artificial Sequence
  Guide Sequence
gcaaacacugacaccucaggga

SEQ ID NO: 5125 - RNA, 22 nt, Artificial Sequence
  Guide Sequence
gccgcaaacacugacaccucag

SEQ ID NO: 5126 - RNA, 22 nt, Artificial Sequence
  Guide Sequence
gcggccgcaaacacugacaccu

SEQ ID NO: 5127 - RNA, 22 nt, Artificial Sequence
  Guide Sequence
ggccgcaaacacugacaccuca

SEQ ID NO: 5128 - RNA, 22 nt, Artificial Sequence
  Guide Sequence
ggugucaguguuugcggccgcu

SEQ ID NO: 5129 - RNA, 22 nt, Artificial Sequence
  Guide Sequence
gucaguguuugcggccgcugug

SEQ ID NO: 5130 - RNA, 22 nt, Artificial Sequence
  Guide Sequence
gucccugaggugucaguguuug

SEQ ID NO: 5131 - RNA, 22 nt, Artificial Sequence
  Guide Sequence
gugucaguguuugcggccgcug

SEQ ID NO: 5132 - RNA, 22 nt, Artificial Sequence
  Guide Sequence
guguuugcggccgcugugggga

SEQ ID NO: 5133 - RNA, 22 nt, Artificial Sequence
  Guide Sequence
ucaguguuugcggccgcugugg

SEQ ID NO: 5134 - RNA, 22 nt, Artificial Sequence
  Guide Sequence
uccccacagcggccgcaaacac

SEQ ID NO: 5135 - RNA, 22 nt, Artificial Sequence
  Guide Sequence
ucccuccccacagcggccgcaa

SEQ ID NO: 5136 - RNA, 22 nt, Artificial Sequence
  Guide Sequence
ucccugaggugucaguguuugc

SEQ ID NO: 5137 - RNA, 22 nt, Artificial Sequence
  Guide Sequence
ucucuuugucccugagguguca

SEQ ID NO: 5138 - RNA, 22 nt, Artificial Sequence
  Guide Sequence
ucuuugucccugaggugucagu

SEQ ID NO: 5139 - RNA, 22 nt, Artificial Sequence
  Guide Sequence
ugacaccucagggacaaagaga

SEQ ID NO: 5140 - RNA, 22 nt, Artificial Sequence
  Guide Sequence
ugaggugucaguguuugcggcc

SEQ ID NO: 5141 - RNA, 22 nt, Artificial Sequence
  Guide Sequence
ugucaguguuugcggccgcugu

SEQ ID NO: 5142 - RNA, 22 nt, Artificial Sequence
  Guide Sequence
ugucccugaggugucaguguuu

SEQ ID NO: 5143 - RNA, 22 nt, Artificial Sequence
  Guide Sequence
uucccuccccacagcggccgca

SEQ ID NO: 5144 - RNA, 22 nt, Artificial Sequence
  Guide Sequence
uugucccugaggugucaguguu

SEQ ID NO: 5145 - RNA, 22 nt, Artificial Sequence
  Guide Sequence
uuugucccugaggugucagugu

SEQ ID NO: 5146 - RNA, 20 nt, Artificial Sequence
  Guide Sequence
aaacugacaccucaggaaca

SEQ ID NO: 5147 - RNA, 20 nt, Artificial Sequence
  Guide Sequence
aacugacaccucaggaacaa

SEQ ID NO: 5148 - RNA, 20 nt, Artificial Sequence
  Guide Sequence
acaccucaggaacaaagaga

SEQ ID NO: 5149 - RNA, 20 nt, Artificial Sequence
  Guide Sequence
accucaggaacaaagagauc

SEQ ID NO: 5150 - RNA, 20 nt, Artificial Sequence
  Guide Sequence
acugacaccucaggaacaaa

SEQ ID NO: 5151 - RNA, 20 nt, Artificial Sequence
  Guide Sequence
agaucucuuuguuccugagg

SEQ ID NO: 5152 - RNA, 20 nt, Artificial Sequence
  Guide Sequence
aggaacaaagagaucuggac

SEQ ID NO: 5153 - RNA, 20 nt, Artificial Sequence
  Guide Sequence
aucucuuuguuccugaggug

SEQ ID NO: 5154 - RNA, 20 nt, Artificial Sequence
  Guide Sequence
auucuguccagaucucuuug

SEQ ID NO: 5155 - RNA, 20 nt, Artificial Sequence
  Guide Sequence
caaacugacaccucaggaac

SEQ ID NO: 5156 - RNA, 20 nt, Artificial Sequence
  Guide Sequence
caccucaggaacaaagagau

SEQ ID NO: 5157 - RNA, 20 nt, Artificial Sequence
  Guide Sequence
cagaucucuuuguuccugag

SEQ ID NO: 5158 - RNA, 20 nt, Artificial Sequence
  Guide Sequence
caggaacaaagagaucugga

SEQ ID NO: 5159 - RNA, 20 nt, Artificial Sequence
  Guide Sequence
ccagaucucuuuguuccuga

SEQ ID NO: 5160 - RNA, 20 nt, Artificial Sequence
  Guide Sequence
ccgcaaacugacaccucagg

SEQ ID NO: 5161 - RNA, 20 nt, Artificial Sequence
  Guide Sequence
ccucaggaacaaagagaucu

SEQ ID NO: 5162 - RNA, 20 nt, Artificial Sequence
  Guide Sequence
cgauucuguccagaucucuu

SEQ ID NO: 5163 - RNA, 20 nt, Artificial Sequence
  Guide Sequence
cgcaaacugacaccucagga

SEQ ID NO: 5164 - RNA, 20 nt, Artificial Sequence
  Guide Sequence
cggccgcaaacugacaccuc

SEQ ID NO: 5165 - RNA, 20 nt, Artificial Sequence
  Guide Sequence
cucaggaacaaagagaucug

SEQ ID NO: 5166 - RNA, 20 nt, Artificial Sequence
  Guide Sequence
cucuuuguuccugagguguc

SEQ ID NO: 5167 - RNA, 20 nt, Artificial Sequence
  Guide Sequence
cugacaccucaggaacaaag

SEQ ID NO: 5168 - RNA, 20 nt, Artificial Sequence
  Guide Sequence
cuguccagaucucuuuguuc

SEQ ID NO: 5169 - RNA, 20 nt, Artificial Sequence
  Guide Sequence
cuuuguuccugaggugucag

SEQ ID NO: 5170 - RNA, 20 nt, Artificial Sequence
  Guide Sequence
gaacaaagagaucuggacag

SEQ ID NO: 5171 - RNA, 20 nt, Artificial Sequence
  Guide Sequence
gacaccucaggaacaaagag

SEQ ID NO: 5172 - RNA, 20 nt, Artificial Sequence
  Guide Sequence
gaucucuuuguuccugaggu

SEQ ID NO: 5173 - RNA, 20 nt, Artificial Sequence
  Guide Sequence
gauucuguccagaucucuuu

SEQ ID NO: 5174 - RNA, 20 nt, Artificial Sequence
  Guide Sequence
gcaaacugacaccucaggaa

SEQ ID NO: 5175 - RNA, 20 nt, Artificial Sequence
  Guide Sequence
gccgcaaacugacaccucag

SEQ ID NO: 5176 - RNA, 20 nt, Artificial Sequence
  Guide Sequence
ggaacaaagagaucuggaca

SEQ ID NO: 5177 - RNA, 20 nt, Artificial Sequence
  Guide Sequence
ggccgcaaacugacaccuca

SEQ ID NO: 5178 - RNA, 20 nt, Artificial Sequence
  Guide Sequence
guccagaucucuuuguuccu

SEQ ID NO: 5179 - RNA, 20 nt, Artificial Sequence
  Guide Sequence
guuccugaggugucaguuug

SEQ ID NO: 5180 - RNA, 20 nt, Artificial Sequence
  Guide Sequence
ucaggaacaaagagaucugg

SEQ ID NO: 5181 - RNA, 20 nt, Artificial Sequence
  Guide Sequence
uccagaucucuuuguuccug

SEQ ID NO: 5182 - RNA, 20 nt, Artificial Sequence
  Guide Sequence
ucucuuuguuccugaggugu

SEQ ID NO: 5183 - RNA, 20 nt, Artificial Sequence
  Guide Sequence
ucuguccagaucucuuuguu

SEQ ID NO: 5184 - RNA, 20 nt, Artificial Sequence
  Guide Sequence
ucuuuguuccugagguguca

SEQ ID NO: 5185 - RNA, 20 nt, Artificial Sequence
  Guide Sequence
ugacaccucaggaacaaaga

SEQ ID NO: 5186 - RNA, 20 nt, Artificial Sequence
  Guide Sequence
uguccagaucucuuuguucc

SEQ ID NO: 5187 - RNA, 20 nt, Artificial Sequence
  Guide Sequence
uguuccugaggugucaguuu

SEQ ID NO: 5188 - RNA, 20 nt, Artificial Sequence
  Guide Sequence
uuccugaggugucaguuugc

SEQ ID NO: 5189 - RNA, 20 nt, Artificial Sequence
  Guide Sequence
uucuguccagaucucuuugu

SEQ ID NO: 5190 - RNA, 20 nt, Artificial Sequence
  Guide Sequence
uuguuccugaggugucaguu

SEQ ID NO: 5191 - RNA, 20 nt, Artificial Sequence
  Guide Sequence
uuuguuccugaggugucagu

SEQ ID NO: 5192 - RNA, 21 nt, Artificial Sequence
  Guide Sequence
aaacugacaccucaggaacaa

SEQ ID NO: 5193 - RNA, 21 nt, Artificial Sequence
  Guide Sequence
aacugacaccucaggaacaaa

SEQ ID NO: 5194 - RNA, 21 nt, Artificial Sequence
  Guide Sequence
acaccucaggaacaaagagau

SEQ ID NO: 5195 - RNA, 21 nt, Artificial Sequence
  Guide Sequence
accucaggaacaaagagaucu

SEQ ID NO: 5196 - RNA, 21 nt, Artificial Sequence
  Guide Sequence
acugacaccucaggaacaaag

SEQ ID NO: 5197 - RNA, 21 nt, Artificial Sequence
  Guide Sequence
agaucucuuuguuccugaggu

SEQ ID NO: 5198 - RNA, 21 nt, Artificial Sequence
  Guide Sequence
aggaacaaagagaucuggaca

SEQ ID NO: 5199 - RNA, 21 nt, Artificial Sequence
  Guide Sequence
aucucuuuguuccugaggugu

SEQ ID NO: 5200 - RNA, 21 nt, Artificial Sequence
  Guide Sequence
auucuguccagaucucuuugu

SEQ ID NO: 5201 - RNA, 21 nt, Artificial Sequence
  Guide Sequence
caaacugacaccucaggaaca

SEQ ID NO: 5202 - RNA, 21 nt, Artificial Sequence
  Guide Sequence
caccucaggaacaaagagauc

SEQ ID NO: 5203 - RNA, 21 nt, Artificial Sequence
  Guide Sequence
cagaucucuuuguuccugagg

SEQ ID NO: 5204 - RNA, 21 nt, Artificial Sequence
  Guide Sequence
caggaacaaagagaucuggac

SEQ ID NO: 5205 - RNA, 21 nt, Artificial Sequence
  Guide Sequence
ccagaucucuuuguuccugag

SEQ ID NO: 5206 - RNA, 21 nt, Artificial Sequence
  Guide Sequence
ccgcaaacugacaccucagga

SEQ ID NO: 5207 - RNA, 21 nt, Artificial Sequence
  Guide Sequence
ccucaggaacaaagagaucug

SEQ ID NO: 5208 - RNA, 21 nt, Artificial Sequence
  Guide Sequence
cgauucuguccagaucucuuu

SEQ ID NO: 5209 - RNA, 21 nt, Artificial Sequence
  Guide Sequence
cgcaaacugacaccucaggaa

SEQ ID NO: 5210 - RNA, 21 nt, Artificial Sequence
  Guide Sequence
cggccgcaaacugacaccuca

SEQ ID NO: 5211 - RNA, 21 nt, Artificial Sequence
  Guide Sequence
cucaggaacaaagagaucugg

SEQ ID NO: 5212 - RNA, 21 nt, Artificial Sequence
  Guide Sequence
cucuuuguuccugagguguca

SEQ ID NO: 5213 - RNA, 21 nt, Artificial Sequence
  Guide Sequence
cugacaccucaggaacaaaga

SEQ ID NO: 5214 - RNA, 21 nt, Artificial Sequence
  Guide Sequence
cuguccagaucucuuuguucc

SEQ ID NO: 5215 - RNA, 21 nt, Artificial Sequence
  Guide Sequence
cuuuguuccugaggugucagu

SEQ ID NO: 5216 - RNA, 21 nt, Artificial Sequence
  Guide Sequence
gaacaaagagaucuggacaga

SEQ ID NO: 5217 - RNA, 21 nt, Artificial Sequence
  Guide Sequence
gacaccucaggaacaaagaga

SEQ ID NO: 5218 - RNA, 21 nt, Artificial Sequence
  Guide Sequence
gaucucuuuguuccugaggug

SEQ ID NO: 5219 - RNA, 21 nt, Artificial Sequence
  Guide Sequence
gauucuguccagaucucuuug

SEQ ID NO: 5220 - RNA, 21 nt, Artificial Sequence
  Guide Sequence
gcaaacugacaccucaggaac

SEQ ID NO: 5221 - RNA, 21 nt, Artificial Sequence
  Guide Sequence
gccgcaaacugacaccucagg

SEQ ID NO: 5222 - RNA, 21 nt, Artificial Sequence
  Guide Sequence
gcgauucuguccagaucucuu

SEQ ID NO: 5223 - RNA, 21 nt, Artificial Sequence
  Guide Sequence
gcggccgcaaacugacaccuc

SEQ ID NO: 5224 - RNA, 21 nt, Artificial Sequence
  Guide Sequence
ggaacaaagagaucuggacag

SEQ ID NO: 5225 - RNA, 21 nt, Artificial Sequence
  Guide Sequence
ggccgcaaacugacaccucag

SEQ ID NO: 5226 - RNA, 21 nt, Artificial Sequence
  Guide Sequence
guccagaucucuuuguuccug

SEQ ID NO: 5227 - RNA, 21 nt, Artificial Sequence
  Guide Sequence
guuccugaggugucaguuugc

SEQ ID NO: 5228 - RNA, 21 nt, Artificial Sequence
  Guide Sequence
ucaggaacaaagagaucugga

SEQ ID NO: 5229 - RNA, 21 nt, Artificial Sequence
  Guide Sequence
uccagaucucuuuguuccuga

SEQ ID NO: 5230 - RNA, 21 nt, Artificial Sequence
  Guide Sequence
ucucuuuguuccugagguguc

SEQ ID NO: 5231 - RNA, 21 nt, Artificial Sequence
  Guide Sequence
ucuguccagaucucuuuguuc

SEQ ID NO: 5232 - RNA, 21 nt, Artificial Sequence
  Guide Sequence
ucuuuguuccugaggugucag

SEQ ID NO: 5233 - RNA, 21 nt, Artificial Sequence
  Guide Sequence
ugacaccucaggaacaaagag

SEQ ID NO: 5234 - RNA, 21 nt, Artificial Sequence
  Guide Sequence
uguccagaucucuuuguuccu

SEQ ID NO: 5235 - RNA, 21 nt, Artificial Sequence
  Guide Sequence
uguuccugaggugucaguuug

SEQ ID NO: 5236 - RNA, 21 nt, Artificial Sequence
  Guide Sequence
uuccugaggugucaguuugcg

SEQ ID NO: 5237 - RNA, 21 nt, Artificial Sequence
  Guide Sequence
uucuguccagaucucuuuguu

SEQ ID NO: 5238 - RNA, 21 nt, Artificial Sequence
  Guide Sequence
uuguuccugaggugucaguuu

SEQ ID NO: 5239 - RNA, 21 nt, Artificial Sequence
  Guide Sequence
uuuguuccugaggugucaguu

SEQ ID NO: 5240 - RNA, 22 nt, Artificial Sequence
  Guide Sequence
aaacugacaccucaggaacaaa

SEQ ID NO: 5241 - RNA, 22 nt, Artificial Sequence
  Guide Sequence
aacugacaccucaggaacaaag

SEQ ID NO: 5242 - RNA, 22 nt, Artificial Sequence
  Guide Sequence
acaccucaggaacaaagagauc

SEQ ID NO: 5243 - RNA, 22 nt, Artificial Sequence
  Guide Sequence
accucaggaacaaagagaucug

SEQ ID NO: 5244 - RNA, 22 nt, Artificial Sequence
  Guide Sequence
acugacaccucaggaacaaaga

SEQ ID NO: 5245 - RNA, 22 nt, Artificial Sequence
  Guide Sequence
agaucucuuuguuccugaggug

SEQ ID NO: 5246 - RNA, 22 nt, Artificial Sequence
  Guide Sequence
agcggccgcaaacugacaccuc

SEQ ID NO: 5247 - RNA, 22 nt, Artificial Sequence
  Guide Sequence
aggaacaaagagaucuggacag

SEQ ID NO: 5248 - RNA, 22 nt, Artificial Sequence
  Guide Sequence
aucucuuuguuccugagguguc

SEQ ID NO: 5249 - RNA, 22 nt, Artificial Sequence
  Guide Sequence
auucuguccagaucucuuuguu

SEQ ID NO: 5250 - RNA, 22 nt, Artificial Sequence
  Guide Sequence
caaacugacaccucaggaacaa

SEQ ID NO: 5251 - RNA, 22 nt, Artificial Sequence
  Guide Sequence
caccucaggaacaaagagaucu

SEQ ID NO: 5252 - RNA, 22 nt, Artificial Sequence
  Guide Sequence
cagaucucuuuguuccugaggu

SEQ ID NO: 5253 - RNA, 22 nt, Artificial Sequence
  Guide Sequence
caggaacaaagagaucuggaca

SEQ ID NO: 5254 - RNA, 22 nt, Artificial Sequence
  Guide Sequence
ccagaucucuuuguuccugagg

SEQ ID NO: 5255 - RNA, 22 nt, Artificial Sequence
  Guide Sequence
ccgcaaacugacaccucaggaa

SEQ ID NO: 5256 - RNA, 22 nt, Artificial Sequence
  Guide Sequence
ccucaggaacaaagagaucugg

SEQ ID NO: 5257 - RNA, 22 nt, Artificial Sequence
  Guide Sequence
cgauucuguccagaucucuuug

SEQ ID NO: 5258 - RNA, 22 nt, Artificial Sequence
  Guide Sequence
cgcaaacugacaccucaggaac

SEQ ID NO: 5259 - RNA, 22 nt, Artificial Sequence
  Guide Sequence
cggccgcaaacugacaccucag

SEQ ID NO: 5260 - RNA, 22 nt, Artificial Sequence
  Guide Sequence
cucaggaacaaagagaucugga

SEQ ID NO: 5261 - RNA, 22 nt, Artificial Sequence
  Guide Sequence
cucuuuguuccugaggugucag

SEQ ID NO: 5262 - RNA, 22 nt, Artificial Sequence
  Guide Sequence
cugacaccucaggaacaaagag

SEQ ID NO: 5263 - RNA, 22 nt, Artificial Sequence
  Guide Sequence
cuguccagaucucuuuguuccu

SEQ ID NO: 5264 - RNA, 22 nt, Artificial Sequence
  Guide Sequence
cuuuguuccugaggugucaguu

SEQ ID NO: 5265 - RNA, 22 nt, Artificial Sequence
  Guide Sequence
gaacaaagagaucuggacagaa

SEQ ID NO: 5266 - RNA, 22 nt, Artificial Sequence
  Guide Sequence
gacaccucaggaacaaagagau

SEQ ID NO: 5267 - RNA, 22 nt, Artificial Sequence
  Guide Sequence
gaucucuuuguuccugaggugu

SEQ ID NO: 5268 - RNA, 22 nt, Artificial Sequence
  Guide Sequence
gauucuguccagaucucuuugu

SEQ ID NO: 5269 - RNA, 22 nt, Artificial Sequence
  Guide Sequence
gcaaacugacaccucaggaaca

SEQ ID NO: 5270 - RNA, 22 nt, Artificial Sequence
  Guide Sequence
gccgcaaacugacaccucagga

SEQ ID NO: 5271 - RNA, 22 nt, Artificial Sequence
  Guide Sequence
gcgauucuguccagaucucuuu

SEQ ID NO: 5272 - RNA, 22 nt, Artificial Sequence
  Guide Sequence
gcggccgcaaacugacaccuca

SEQ ID NO: 5273 - RNA, 22 nt, Artificial Sequence
  Guide Sequence
ggaacaaagagaucuggacaga

SEQ ID NO: 5274 - RNA, 22 nt, Artificial Sequence
  Guide Sequence
ggccgcaaacugacaccucagg

SEQ ID NO: 5275 - RNA, 22 nt, Artificial Sequence
  Guide Sequence
ggcgauucuguccagaucucuu

SEQ ID NO: 5276 - RNA, 22 nt, Artificial Sequence
  Guide Sequence
guccagaucucuuuguuccuga

SEQ ID NO: 5277 - RNA, 22 nt, Artificial Sequence
  Guide Sequence
guuccugaggugucaguuugcg

SEQ ID NO: 5278 - RNA, 22 nt, Artificial Sequence
  Guide Sequence
ucaggaacaaagagaucuggac

SEQ ID NO: 5279 - RNA, 22 nt, Artificial Sequence
  Guide Sequence
uccagaucucuuuguuccugag

SEQ ID NO: 5280 - RNA, 22 nt, Artificial Sequence
  Guide Sequence
ucucuuuguuccugagguguca

SEQ ID NO: 5281 - RNA, 22 nt, Artificial Sequence
  Guide Sequence
ucuguccagaucucuuuguucc

SEQ ID NO: 5282 - RNA, 22 nt, Artificial Sequence
  Guide Sequence
ucuuuguuccugaggugucagu

SEQ ID NO: 5283 - RNA, 22 nt, Artificial Sequence
  Guide Sequence
ugacaccucaggaacaaagaga

SEQ ID NO: 5284 - RNA, 22 nt, Artificial Sequence
  Guide Sequence
uguccagaucucuuuguuccug

SEQ ID NO: 5285 - RNA, 22 nt, Artificial Sequence
  Guide Sequence
uguuccugaggugucaguuugc

SEQ ID NO: 5286 - RNA, 22 nt, Artificial Sequence
  Guide Sequence
uuccugaggugucaguuugcgg

SEQ ID NO: 5287 - RNA, 22 nt, Artificial Sequence
  Guide Sequence
uucuguccagaucucuuuguuc

SEQ ID NO: 5288 - RNA, 22 nt, Artificial Sequence
  Guide Sequence
uuguuccugaggugucaguuug

SEQ ID NO: 5289 - RNA, 22 nt, Artificial Sequence
  Guide Sequence
uuuguuccugaggugucaguuu

SEQ ID NO: 5290 - RNA, 20 nt, Artificial Sequence
  Guide Sequence
aaacugacaccucagggaca

SEQ ID NO: 5291 - RNA, 20 nt, Artificial Sequence
  Guide Sequence
aacugacaccucagggacag

SEQ ID NO: 5292 - RNA, 20 nt, Artificial Sequence
  Guide Sequence
acaccucagggacagagauc

SEQ ID NO: 5293 - RNA, 20 nt, Artificial Sequence
  Guide Sequence
acagagaucuggacagaauc

SEQ ID NO: 5294 - RNA, 20 nt, Artificial Sequence
  Guide Sequence
accucagggacagagaucug

SEQ ID NO: 5295 - RNA, 20 nt, Artificial Sequence
  Guide Sequence
acugacaccucagggacaga

SEQ ID NO: 5296 - RNA, 20 nt, Artificial Sequence
  Guide Sequence
agaucucugucccugaggug

SEQ ID NO: 5297 - RNA, 20 nt, Artificial Sequence
  Guide Sequence
agggacagagaucuggacag

SEQ ID NO: 5298 - RNA, 20 nt, Artificial Sequence
  Guide Sequence
aucucugucccugagguguc

SEQ ID NO: 5299 - RNA, 20 nt, Artificial Sequence
  Guide Sequence
auucuguccagaucucuguc

SEQ ID NO: 5300 - RNA, 20 nt, Artificial Sequence
  Guide Sequence
caaacugacaccucagggac

SEQ ID NO: 5301 - RNA, 20 nt, Artificial Sequence
  Guide Sequence
caccucagggacagagaucu

SEQ ID NO: 5302 - RNA, 20 nt, Artificial Sequence
  Guide Sequence
cagaucucugucccugaggu

SEQ ID NO: 5303 - RNA, 20 nt, Artificial Sequence
  Guide Sequence
cagggacagagaucuggaca

SEQ ID NO: 5304 - RNA, 20 nt, Artificial Sequence
  Guide Sequence
ccagaucucugucccugagg

SEQ ID NO: 5305 - RNA, 20 nt, Artificial Sequence
  Guide Sequence
ccggcgauucuguccagauc

SEQ ID NO: 5306 - RNA, 20 nt, Artificial Sequence
  Guide Sequence
ccucagggacagagaucugg

SEQ ID NO: 5307 - RNA, 20 nt, Artificial Sequence
  Guide Sequence
cgauucuguccagaucucug

SEQ ID NO: 5308 - RNA, 20 nt, Artificial Sequence
  Guide Sequence
cgcaaacugacaccucaggg

SEQ ID NO: 5309 - RNA, 20 nt, Artificial Sequence
  Guide Sequence
cggcgauucuguccagaucu

SEQ ID NO: 5310 - RNA, 20 nt, Artificial Sequence
  Guide Sequence
cucagggacagagaucugga

SEQ ID NO: 5311 - RNA, 20 nt, Artificial Sequence
  Guide Sequence
cucugucccugaggugucag

SEQ ID NO: 5312 - RNA, 20 nt, Artificial Sequence
  Guide Sequence
cugacaccucagggacagag

SEQ ID NO: 5313 - RNA, 20 nt, Artificial Sequence
  Guide Sequence
cuguccagaucucugucccu

SEQ ID NO: 5314 - RNA, 20 nt, Artificial Sequence
  Guide Sequence
cugucccugaggugucaguu

SEQ ID NO: 5315 - RNA, 20 nt, Artificial Sequence
  Guide Sequence
gacaccucagggacagagau

SEQ ID NO: 5316 - RNA, 20 nt, Artificial Sequence
  Guide Sequence
gacagagaucuggacagaau

SEQ ID NO: 5317 - RNA, 20 nt, Artificial Sequence
  Guide Sequence
gaucucugucccugaggugu

SEQ ID NO: 5318 - RNA, 20 nt, Artificial Sequence
  Guide Sequence
gauucuguccagaucucugu

SEQ ID NO: 5319 - RNA, 20 nt, Artificial Sequence
  Guide Sequence
gcaaacugacaccucaggga

SEQ ID NO: 5320 - RNA, 20 nt, Artificial Sequence
  Guide Sequence
gcgauucuguccagaucucu

SEQ ID NO: 5321 - RNA, 20 nt, Artificial Sequence
  Guide Sequence
ggacagagaucuggacagaa

SEQ ID NO: 5322 - RNA, 20 nt, Artificial Sequence
  Guide Sequence
ggcgauucuguccagaucuc

SEQ ID NO: 5323 - RNA, 20 nt, Artificial Sequence
  Guide Sequence
gggacagagaucuggacaga

SEQ ID NO: 5324 - RNA, 20 nt, Artificial Sequence
  Guide Sequence
guccagaucucugucccuga

SEQ ID NO: 5325 - RNA, 20 nt, Artificial Sequence
  Guide Sequence
ucagggacagagaucuggac

SEQ ID NO: 5326 - RNA, 20 nt, Artificial Sequence
  Guide Sequence
uccagaucucugucccugag

SEQ ID NO: 5327 - RNA, 20 nt, Artificial Sequence
  Guide Sequence
ucucugucccugagguguca

SEQ ID NO: 5328 - RNA, 20 nt, Artificial Sequence
  Guide Sequence
ucuguccagaucucuguccc

SEQ ID NO: 5329 - RNA, 20 nt, Artificial Sequence
  Guide Sequence
ucugucccugaggugucagu

SEQ ID NO: 5330 - RNA, 20 nt, Artificial Sequence
  Guide Sequence
ugacaccucagggacagaga

SEQ ID NO: 5331 - RNA, 20 nt, Artificial Sequence
  Guide Sequence
uguccagaucucugucccug

SEQ ID NO: 5332 - RNA, 20 nt, Artificial Sequence
  Guide Sequence
ugucccugaggugucaguuu

SEQ ID NO: 5333 - RNA, 20 nt, Artificial Sequence
  Guide Sequence
uucuguccagaucucugucc

SEQ ID NO: 5334 - RNA, 21 nt, Artificial Sequence
  Guide Sequence
aaacugacaccucagggacag

SEQ ID NO: 5335 - RNA, 21 nt, Artificial Sequence
  Guide Sequence
aacugacaccucagggacaga

SEQ ID NO: 5336 - RNA, 21 nt, Artificial Sequence
  Guide Sequence
acaccucagggacagagaucu

SEQ ID NO: 5337 - RNA, 21 nt, Artificial Sequence
  Guide Sequence
acagagaucuggacagaaucg

SEQ ID NO: 5338 - RNA, 21 nt, Artificial Sequence
  Guide Sequence
accucagggacagagaucugg

SEQ ID NO: 5339 - RNA, 21 nt, Artificial Sequence
  Guide Sequence
acugacaccucagggacagag

SEQ ID NO: 5340 - RNA, 21 nt, Artificial Sequence
  Guide Sequence
agaucucugucccugaggugu

SEQ ID NO: 5341 - RNA, 21 nt, Artificial Sequence
  Guide Sequence
agggacagagaucuggacaga

SEQ ID NO: 5342 - RNA, 21 nt, Artificial Sequence
  Guide Sequence
aucucugucccugagguguca

SEQ ID NO: 5343 - RNA, 21 nt, Artificial Sequence
  Guide Sequence
auucuguccagaucucugucc

SEQ ID NO: 5344 - RNA, 21 nt, Artificial Sequence
  Guide Sequence
caaacugacaccucagggaca

SEQ ID NO: 5345 - RNA, 21 nt, Artificial Sequence
  Guide Sequence
caccucagggacagagaucug

SEQ ID NO: 5346 - RNA, 21 nt, Artificial Sequence
  Guide Sequence
cagaucucugucccugaggug

SEQ ID NO: 5347 - RNA, 21 nt, Artificial Sequence
  Guide Sequence
cagggacagagaucuggacag

SEQ ID NO: 5348 - RNA, 21 nt, Artificial Sequence
  Guide Sequence
ccagaucucugucccugaggu

SEQ ID NO: 5349 - RNA, 21 nt, Artificial Sequence
  Guide Sequence
ccgcaaacugacaccucaggg

SEQ ID NO: 5350 - RNA, 21 nt, Artificial Sequence
  Guide Sequence
ccggcgauucuguccagaucu

SEQ ID NO: 5351 - RNA, 21 nt, Artificial Sequence
  Guide Sequence
ccucagggacagagaucugga

SEQ ID NO: 5352 - RNA, 21 nt, Artificial Sequence
  Guide Sequence
cgauucuguccagaucucugu

SEQ ID NO: 5353 - RNA, 21 nt, Artificial Sequence
  Guide Sequence
cgcaaacugacaccucaggga

SEQ ID NO: 5354 - RNA, 21 nt, Artificial Sequence
  Guide Sequence
cggcgauucuguccagaucuc

SEQ ID NO: 5355 - RNA, 21 nt, Artificial Sequence
  Guide Sequence
cucagggacagagaucuggac

SEQ ID NO: 5356 - RNA, 21 nt, Artificial Sequence
  Guide Sequence
cucugucccugaggugucagu

SEQ ID NO: 5357 - RNA, 21 nt, Artificial Sequence
  Guide Sequence
cugacaccucagggacagaga

SEQ ID NO: 5358 - RNA, 21 nt, Artificial Sequence
  Guide Sequence
cuguccagaucucugucccug

SEQ ID NO: 5359 - RNA, 21 nt, Artificial Sequence
  Guide Sequence
cugucccugaggugucaguuu

SEQ ID NO: 5360 - RNA, 21 nt, Artificial Sequence
  Guide Sequence
gacaccucagggacagagauc

SEQ ID NO: 5361 - RNA, 21 nt, Artificial Sequence
  Guide Sequence
gacagagaucuggacagaauc

SEQ ID NO: 5362 - RNA, 21 nt, Artificial Sequence
  Guide Sequence
gaucucugucccugagguguc

SEQ ID NO: 5363 - RNA, 21 nt, Artificial Sequence
  Guide Sequence
gauucuguccagaucucuguc

SEQ ID NO: 5364 - RNA, 21 nt, Artificial Sequence
  Guide Sequence
gcaaacugacaccucagggac

SEQ ID NO: 5365 - RNA, 21 nt, Artificial Sequence
  Guide Sequence
gcgauucuguccagaucucug

SEQ ID NO: 5366 - RNA, 21 nt, Artificial Sequence
  Guide Sequence
ggacagagaucuggacagaau

SEQ ID NO: 5367 - RNA, 21 nt, Artificial Sequence
  Guide Sequence
ggcgauucuguccagaucucu

SEQ ID NO: 5368 - RNA, 21 nt, Artificial Sequence
  Guide Sequence
gggacagagaucuggacagaa

SEQ ID NO: 5369 - RNA, 21 nt, Artificial Sequence
  Guide Sequence
guccagaucucugucccugag

SEQ ID NO: 5370 - RNA, 21 nt, Artificial Sequence
  Guide Sequence
ucagggacagagaucuggaca

SEQ ID NO: 5371 - RNA, 21 nt, Artificial Sequence
  Guide Sequence
uccagaucucugucccugagg

SEQ ID NO: 5372 - RNA, 21 nt, Artificial Sequence
  Guide Sequence
uccggcgauucuguccagauc

SEQ ID NO: 5373 - RNA, 21 nt, Artificial Sequence
  Guide Sequence
ucucugucccugaggugucag

SEQ ID NO: 5374 - RNA, 21 nt, Artificial Sequence
  Guide Sequence
ucuguccagaucucugucccu

SEQ ID NO: 5375 - RNA, 21 nt, Artificial Sequence
  Guide Sequence
ucugucccugaggugucaguu

SEQ ID NO: 5376 - RNA, 21 nt, Artificial Sequence
  Guide Sequence
ugacaccucagggacagagau

SEQ ID NO: 5377 - RNA, 21 nt, Artificial Sequence
  Guide Sequence
uguccagaucucugucccuga

SEQ ID NO: 5378 - RNA, 21 nt, Artificial Sequence
  Guide Sequence
ugucccugaggugucaguuug

SEQ ID NO: 5379 - RNA, 21 nt, Artificial Sequence
  Guide Sequence
uucuguccagaucucuguccc

SEQ ID NO: 5380 - RNA, 22 nt, Artificial Sequence
  Guide Sequence
aaacugacaccucagggacaga

SEQ ID NO: 5381 - RNA, 22 nt, Artificial Sequence
  Guide Sequence
aacugacaccucagggacagag

SEQ ID NO: 5382 - RNA, 22 nt, Artificial Sequence
  Guide Sequence
acaccucagggacagagaucug

SEQ ID NO: 5383 - RNA, 22 nt, Artificial Sequence
  Guide Sequence
acagagaucuggacagaaucgc

SEQ ID NO: 5384 - RNA, 22 nt, Artificial Sequence
  Guide Sequence
accucagggacagagaucugga

SEQ ID NO: 5385 - RNA, 22 nt, Artificial Sequence
  Guide Sequence
acugacaccucagggacagaga

SEQ ID NO: 5386 - RNA, 22 nt, Artificial Sequence
  Guide Sequence
agaucucugucccugagguguc

SEQ ID NO: 5387 - RNA, 22 nt, Artificial Sequence
  Guide Sequence
agggacagagaucuggacagaa

SEQ ID NO: 5388 - RNA, 22 nt, Artificial Sequence
  Guide Sequence
aucucugucccugaggugucag

SEQ ID NO: 5389 - RNA, 22 nt, Artificial Sequence
  Guide Sequence
auucuguccagaucucuguccc

SEQ ID NO: 5390 - RNA, 22 nt, Artificial Sequence
  Guide Sequence
caaacugacaccucagggacag

SEQ ID NO: 5391 - RNA, 22 nt, Artificial Sequence
  Guide Sequence
caccucagggacagagaucugg

SEQ ID NO: 5392 - RNA, 22 nt, Artificial Sequence
  Guide Sequence
cagaucucugucccugaggugu

SEQ ID NO: 5393 - RNA, 22 nt, Artificial Sequence
  Guide Sequence
cagggacagagaucuggacaga

SEQ ID NO: 5394 - RNA, 22 nt, Artificial Sequence
  Guide Sequence
ccagaucucugucccugaggug

SEQ ID NO: 5395 - RNA, 22 nt, Artificial Sequence
  Guide Sequence
ccgcaaacugacaccucaggga

SEQ ID NO: 5396 - RNA, 22 nt, Artificial Sequence
  Guide Sequence
ccggcgauucuguccagaucuc

SEQ ID NO: 5397 - RNA, 22 nt, Artificial Sequence
  Guide Sequence
ccucagggacagagaucuggac

SEQ ID NO: 5398 - RNA, 22 nt, Artificial Sequence
  Guide Sequence
cgauucuguccagaucucuguc

SEQ ID NO: 5399 - RNA, 22 nt, Artificial Sequence
  Guide Sequence
cgcaaacugacaccucagggac

SEQ ID NO: 5400 - RNA, 22 nt, Artificial Sequence
  Guide Sequence
cggcgauucuguccagaucucu

SEQ ID NO: 5401 - RNA, 22 nt, Artificial Sequence
  Guide Sequence
cucagggacagagaucuggaca

SEQ ID NO: 5402 - RNA, 22 nt, Artificial Sequence
  Guide Sequence
cucugucccugaggugucaguu

SEQ ID NO: 5403 - RNA, 22 nt, Artificial Sequence
  Guide Sequence
cugacaccucagggacagagau

SEQ ID NO: 5404 - RNA, 22 nt, Artificial Sequence
  Guide Sequence
cuguccagaucucugucccuga

SEQ ID NO: 5405 - RNA, 22 nt, Artificial Sequence
  Guide Sequence
cugucccugaggugucaguuug

SEQ ID NO: 5406 - RNA, 22 nt, Artificial Sequence
  Guide Sequence
gacaccucagggacagagaucu

SEQ ID NO: 5407 - RNA, 22 nt, Artificial Sequence
  Guide Sequence
gacagagaucuggacagaaucg

SEQ ID NO: 5408 - RNA, 22 nt, Artificial Sequence
  Guide Sequence
gaucucugucccugagguguca

SEQ ID NO: 5409 - RNA, 22 nt, Artificial Sequence
  Guide Sequence
gauucuguccagaucucugucc

SEQ ID NO: 5410 - RNA, 22 nt, Artificial Sequence
  Guide Sequence
gcaaacugacaccucagggaca

SEQ ID NO: 5411 - RNA, 22 nt, Artificial Sequence
  Guide Sequence
gccgcaaacugacaccucaggg

SEQ ID NO: 5412 - RNA, 22 nt, Artificial Sequence
  Guide Sequence
gcgauucuguccagaucucugu

SEQ ID NO: 5413 - RNA, 22 nt, Artificial Sequence
  Guide Sequence
ggacagagaucuggacagaauc

SEQ ID NO: 5414 - RNA, 22 nt, Artificial Sequence
  Guide Sequence
ggcgauucuguccagaucucug

SEQ ID NO: 5415 - RNA, 22 nt, Artificial Sequence
  Guide Sequence
gggacagagaucuggacagaau

SEQ ID NO: 5416 - RNA, 22 nt, Artificial Sequence
  Guide Sequence
guccagaucucugucccugagg

SEQ ID NO: 5417 - RNA, 22 nt, Artificial Sequence
  Guide Sequence
guccggcgauucuguccagauc

SEQ ID NO: 5418 - RNA, 22 nt, Artificial Sequence
  Guide Sequence
ucagggacagagaucuggacag

SEQ ID NO: 5419 - RNA, 22 nt, Artificial Sequence
  Guide Sequence
uccagaucucugucccugaggu

SEQ ID NO: 5420 - RNA, 22 nt, Artificial Sequence
  Guide Sequence
uccggcgauucuguccagaucu

SEQ ID NO: 5421 - RNA, 22 nt, Artificial Sequence
  Guide Sequence
ucucugucccugaggugucagu

SEQ ID NO: 5422 - RNA, 22 nt, Artificial Sequence
  Guide Sequence
ucuguccagaucucugucccug

SEQ ID NO: 5423 - RNA, 22 nt, Artificial Sequence
  Guide Sequence
ucugucccugaggugucaguuu

SEQ ID NO: 5424 - RNA, 22 nt, Artificial Sequence
  Guide Sequence
ugacaccucagggacagagauc

SEQ ID NO: 5425 - RNA, 22 nt, Artificial Sequence
  Guide Sequence
uguccagaucucugucccugag

SEQ ID NO: 5426 - RNA, 22 nt, Artificial Sequence
  Guide Sequence
ugucccugaggugucaguuugc

SEQ ID NO: 5427 - RNA, 22 nt, Artificial Sequence
  Guide Sequence
uucuguccagaucucugucccu

SEQ ID NO: 5428 - RNA, 20 nt, Artificial Sequence
  Guide Sequence
aaacugacaccucagggaua

SEQ ID NO: 5429 - RNA, 20 nt, Artificial Sequence
  Guide Sequence
aacugacaccucagggauaa

SEQ ID NO: 5430 - RNA, 20 nt, Artificial Sequence
  Guide Sequence
acaccucagggauaaagaga

SEQ ID NO: 5431 - RNA, 20 nt, Artificial Sequence
  Guide Sequence
accucagggauaaagagauc

SEQ ID NO: 5432 - RNA, 20 nt, Artificial Sequence
  Guide Sequence
acugacaccucagggauaaa

SEQ ID NO: 5433 - RNA, 20 nt, Artificial Sequence
  Guide Sequence
agaucucuuuaucccugagg

SEQ ID NO: 5434 - RNA, 20 nt, Artificial Sequence
  Guide Sequence
agggauaaagagaucuggac

SEQ ID NO: 5435 - RNA, 20 nt, Artificial Sequence
  Guide Sequence
auaaagagaucuggacagaa

SEQ ID NO: 5436 - RNA, 20 nt, Artificial Sequence
  Guide Sequence
aucucuuuaucccugaggug

SEQ ID NO: 5437 - RNA, 20 nt, Artificial Sequence
  Guide Sequence
auucuguccagaucucuuua

SEQ ID NO: 5438 - RNA, 20 nt, Artificial Sequence
  Guide Sequence
caaacugacaccucagggau

SEQ ID NO: 5439 - RNA, 20 nt, Artificial Sequence
  Guide Sequence
caccucagggauaaagagau

SEQ ID NO: 5440 - RNA, 20 nt, Artificial Sequence
  Guide Sequence
cagaucucuuuaucccugag

SEQ ID NO: 5441 - RNA, 20 nt, Artificial Sequence
  Guide Sequence
cagggauaaagagaucugga

SEQ ID NO: 5442 - RNA, 20 nt, Artificial Sequence
  Guide Sequence
ccagaucucuuuaucccuga

SEQ ID NO: 5443 - RNA, 20 nt, Artificial Sequence
  Guide Sequence
ccucagggauaaagagaucu

SEQ ID NO: 5444 - RNA, 20 nt, Artificial Sequence
  Guide Sequence
cucagggauaaagagaucug

SEQ ID NO: 5445 - RNA, 20 nt, Artificial Sequence
  Guide Sequence
cucuuuaucccugagguguc

SEQ ID NO: 5446 - RNA, 20 nt, Artificial Sequence
  Guide Sequence
cugacaccucagggauaaag

SEQ ID NO: 5447 - RNA, 20 nt, Artificial Sequence
  Guide Sequence
cuguccagaucucuuuaucc

SEQ ID NO: 5448 - RNA, 20 nt, Artificial Sequence
  Guide Sequence
cuuuaucccugaggugucag

SEQ ID NO: 5449 - RNA, 20 nt, Artificial Sequence
  Guide Sequence
gacaccucagggauaaagag

SEQ ID NO: 5450 - RNA, 20 nt, Artificial Sequence
  Guide Sequence
gauaaagagaucuggacaga

SEQ ID NO: 5451 - RNA, 20 nt, Artificial Sequence
  Guide Sequence
gaucucuuuaucccugaggu

SEQ ID NO: 5452 - RNA, 20 nt, Artificial Sequence
  Guide Sequence
ggauaaagagaucuggacag

SEQ ID NO: 5453 - RNA, 20 nt, Artificial Sequence
  Guide Sequence
gggauaaagagaucuggaca

SEQ ID NO: 5454 - RNA, 20 nt, Artificial Sequence
  Guide Sequence
guccagaucucuuuaucccu

SEQ ID NO: 5455 - RNA, 20 nt, Artificial Sequence
  Guide Sequence
uaucccugaggugucaguuu

SEQ ID NO: 5456 - RNA, 20 nt, Artificial Sequence
  Guide Sequence
ucagggauaaagagaucugg

SEQ ID NO: 5457 - RNA, 20 nt, Artificial Sequence
  Guide Sequence
uccagaucucuuuaucccug

SEQ ID NO: 5458 - RNA, 20 nt, Artificial Sequence
  Guide Sequence
ucucuuuaucccugaggugu

SEQ ID NO: 5459 - RNA, 20 nt, Artificial Sequence
  Guide Sequence
ucuguccagaucucuuuauc

SEQ ID NO: 5460 - RNA, 20 nt, Artificial Sequence
  Guide Sequence
ucuuuaucccugagguguca

SEQ ID NO: 5461 - RNA, 20 nt, Artificial Sequence
  Guide Sequence
ugacaccucagggauaaaga

SEQ ID NO: 5462 - RNA, 20 nt, Artificial Sequence
  Guide Sequence
uguccagaucucuuuauccc

SEQ ID NO: 5463 - RNA, 20 nt, Artificial Sequence
  Guide Sequence
uuaucccugaggugucaguu

SEQ ID NO: 5464 - RNA, 20 nt, Artificial Sequence
  Guide Sequence
uucuguccagaucucuuuau

SEQ ID NO: 5465 - RNA, 20 nt, Artificial Sequence
  Guide Sequence
uuuaucccugaggugucagu

SEQ ID NO: 5466 - RNA, 21 nt, Artificial Sequence
  Guide Sequence
aaacugacaccucagggauaa

SEQ ID NO: 5467 - RNA, 21 nt, Artificial Sequence
  Guide Sequence
aacugacaccucagggauaaa

SEQ ID NO: 5468 - RNA, 21 nt, Artificial Sequence
  Guide Sequence
acaccucagggauaaagagau

SEQ ID NO: 5469 - RNA, 21 nt, Artificial Sequence
  Guide Sequence
accucagggauaaagagaucu

SEQ ID NO: 5470 - RNA, 21 nt, Artificial Sequence
  Guide Sequence
acugacaccucagggauaaag

SEQ ID NO: 5471 - RNA, 21 nt, Artificial Sequence
  Guide Sequence
agaucucuuuaucccugaggu

SEQ ID NO: 5472 - RNA, 21 nt, Artificial Sequence
  Guide Sequence
agggauaaagagaucuggaca

SEQ ID NO: 5473 - RNA, 21 nt, Artificial Sequence
  Guide Sequence
auaaagagaucuggacagaau

SEQ ID NO: 5474 - RNA, 21 nt, Artificial Sequence
  Guide Sequence
aucucuuuaucccugaggugu

SEQ ID NO: 5475 - RNA, 21 nt, Artificial Sequence
  Guide Sequence
auucuguccagaucucuuuau

SEQ ID NO: 5476 - RNA, 21 nt, Artificial Sequence
  Guide Sequence
caaacugacaccucagggaua

SEQ ID NO: 5477 - RNA, 21 nt, Artificial Sequence
  Guide Sequence
caccucagggauaaagagauc

SEQ ID NO: 5478 - RNA, 21 nt, Artificial Sequence
  Guide Sequence
cagaucucuuuaucccugagg

SEQ ID NO: 5479 - RNA, 21 nt, Artificial Sequence
  Guide Sequence
cagggauaaagagaucuggac

SEQ ID NO: 5480 - RNA, 21 nt, Artificial Sequence
  Guide Sequence
ccagaucucuuuaucccugag

SEQ ID NO: 5481 - RNA, 21 nt, Artificial Sequence
  Guide Sequence
ccucagggauaaagagaucug

SEQ ID NO: 5482 - RNA, 21 nt, Artificial Sequence
  Guide Sequence
cucagggauaaagagaucugg

SEQ ID NO: 5483 - RNA, 21 nt, Artificial Sequence
  Guide Sequence
cucuuuaucccugagguguca

SEQ ID NO: 5484 - RNA, 21 nt, Artificial Sequence
  Guide Sequence
cugacaccucagggauaaaga

SEQ ID NO: 5485 - RNA, 21 nt, Artificial Sequence
  Guide Sequence
cuguccagaucucuuuauccc

SEQ ID NO: 5486 - RNA, 21 nt, Artificial Sequence
  Guide Sequence
cuuuaucccugaggugucagu

SEQ ID NO: 5487 - RNA, 21 nt, Artificial Sequence
  Guide Sequence
gacaccucagggauaaagaga

SEQ ID NO: 5488 - RNA, 21 nt, Artificial Sequence
  Guide Sequence
gauaaagagaucuggacagaa

SEQ ID NO: 5489 - RNA, 21 nt, Artificial Sequence
  Guide Sequence
gaucucuuuaucccugaggug

SEQ ID NO: 5490 - RNA, 21 nt, Artificial Sequence
  Guide Sequence
gauucuguccagaucucuuua

SEQ ID NO: 5491 - RNA, 21 nt, Artificial Sequence
  Guide Sequence
gcaaacugacaccucagggau

SEQ ID NO: 5492 - RNA, 21 nt, Artificial Sequence
  Guide Sequence
ggauaaagagaucuggacaga

SEQ ID NO: 5493 - RNA, 21 nt, Artificial Sequence
  Guide Sequence
gggauaaagagaucuggacag

SEQ ID NO: 5494 - RNA, 21 nt, Artificial Sequence
  Guide Sequence
guccagaucucuuuaucccug

SEQ ID NO: 5495 - RNA, 21 nt, Artificial Sequence
  Guide Sequence
uaucccugaggugucaguuug

SEQ ID NO: 5496 - RNA, 21 nt, Artificial Sequence
  Guide Sequence
ucagggauaaagagaucugga

SEQ ID NO: 5497 - RNA, 21 nt, Artificial Sequence
  Guide Sequence
uccagaucucuuuaucccuga

SEQ ID NO: 5498 - RNA, 21 nt, Artificial Sequence
  Guide Sequence
ucucuuuaucccugagguguc

SEQ ID NO: 5499 - RNA, 21 nt, Artificial Sequence
  Guide Sequence
ucuguccagaucucuuuaucc

SEQ ID NO: 5500 - RNA, 21 nt, Artificial Sequence
  Guide Sequence
ucuuuaucccugaggugucag

SEQ ID NO: 5501 - RNA, 21 nt, Artificial Sequence
  Guide Sequence
ugacaccucagggauaaagag

SEQ ID NO: 5502 - RNA, 21 nt, Artificial Sequence
  Guide Sequence
uguccagaucucuuuaucccu

SEQ ID NO: 5503 - RNA, 21 nt, Artificial Sequence
  Guide Sequence
uuaucccugaggugucaguuu

SEQ ID NO: 5504 - RNA, 21 nt, Artificial Sequence
  Guide Sequence
uucuguccagaucucuuuauc

SEQ ID NO: 5505 - RNA, 21 nt, Artificial Sequence
  Guide Sequence
uuuaucccugaggugucaguu

SEQ ID NO: 5506 - RNA, 22 nt, Artificial Sequence
  Guide Sequence
aaacugacaccucagggauaaa

SEQ ID NO: 5507 - RNA, 22 nt, Artificial Sequence
  Guide Sequence
aacugacaccucagggauaaag

SEQ ID NO: 5508 - RNA, 22 nt, Artificial Sequence
  Guide Sequence
acaccucagggauaaagagauc

SEQ ID NO: 5509 - RNA, 22 nt, Artificial Sequence
  Guide Sequence
accucagggauaaagagaucug

SEQ ID NO: 5510 - RNA, 22 nt, Artificial Sequence
  Guide Sequence
acugacaccucagggauaaaga

SEQ ID NO: 5511 - RNA, 22 nt, Artificial Sequence
  Guide Sequence
agaucucuuuaucccugaggug

SEQ ID NO: 5512 - RNA, 22 nt, Artificial Sequence
  Guide Sequence
agggauaaagagaucuggacag

SEQ ID NO: 5513 - RNA, 22 nt, Artificial Sequence
  Guide Sequence
auaaagagaucuggacagaauc

SEQ ID NO: 5514 - RNA, 22 nt, Artificial Sequence
  Guide Sequence
aucucuuuaucccugagguguc

SEQ ID NO: 5515 - RNA, 22 nt, Artificial Sequence
  Guide Sequence
auucuguccagaucucuuuauc

SEQ ID NO: 5516 - RNA, 22 nt, Artificial Sequence
  Guide Sequence
caaacugacaccucagggauaa

SEQ ID NO: 5517 - RNA, 22 nt, Artificial Sequence
  Guide Sequence
caccucagggauaaagagaucu

SEQ ID NO: 5518 - RNA, 22 nt, Artificial Sequence
  Guide Sequence
cagaucucuuuaucccugaggu

SEQ ID NO: 5519 - RNA, 22 nt, Artificial Sequence
  Guide Sequence
cagggauaaagagaucuggaca

SEQ ID NO: 5520 - RNA, 22 nt, Artificial Sequence
  Guide Sequence
ccagaucucuuuaucccugagg

SEQ ID NO: 5521 - RNA, 22 nt, Artificial Sequence
  Guide Sequence
ccucagggauaaagagaucugg

SEQ ID NO: 5522 - RNA, 22 nt, Artificial Sequence
  Guide Sequence
cgauucuguccagaucucuuua

SEQ ID NO: 5523 - RNA, 22 nt, Artificial Sequence
  Guide Sequence
cgcaaacugacaccucagggau

SEQ ID NO: 5524 - RNA, 22 nt, Artificial Sequence
  Guide Sequence
cucagggauaaagagaucugga

SEQ ID NO: 5525 - RNA, 22 nt, Artificial Sequence
  Guide Sequence
cucuuuaucccugaggugucag

SEQ ID NO: 5526 - RNA, 22 nt, Artificial Sequence
  Guide Sequence
cugacaccucagggauaaagag

SEQ ID NO: 5527 - RNA, 22 nt, Artificial Sequence
  Guide Sequence
cuguccagaucucuuuaucccu

SEQ ID NO: 5528 - RNA, 22 nt, Artificial Sequence
  Guide Sequence
cuuuaucccugaggugucaguu

SEQ ID NO: 5529 - RNA, 22 nt, Artificial Sequence
  Guide Sequence
gacaccucagggauaaagagau

SEQ ID NO: 5530 - RNA, 22 nt, Artificial Sequence
  Guide Sequence
gauaaagagaucuggacagaau

SEQ ID NO: 5531 - RNA, 22 nt, Artificial Sequence
  Guide Sequence
gaucucuuuaucccugaggugu

SEQ ID NO: 5532 - RNA, 22 nt, Artificial Sequence
  Guide Sequence
gauucuguccagaucucuuuau

SEQ ID NO: 5533 - RNA, 22 nt, Artificial Sequence
  Guide Sequence
gcaaacugacaccucagggaua

SEQ ID NO: 5534 - RNA, 22 nt, Artificial Sequence
  Guide Sequence
ggauaaagagaucuggacagaa

SEQ ID NO: 5535 - RNA, 22 nt, Artificial Sequence
  Guide Sequence
gggauaaagagaucuggacaga

SEQ ID NO: 5536 - RNA, 22 nt, Artificial Sequence
  Guide Sequence
guccagaucucuuuaucccuga

SEQ ID NO: 5537 - RNA, 22 nt, Artificial Sequence
  Guide Sequence
uaucccugaggugucaguuugc

SEQ ID NO: 5538 - RNA, 22 nt, Artificial Sequence
  Guide Sequence
ucagggauaaagagaucuggac

SEQ ID NO: 5539 - RNA, 22 nt, Artificial Sequence
  Guide Sequence
uccagaucucuuuaucccugag

SEQ ID NO: 5540 - RNA, 22 nt, Artificial Sequence
  Guide Sequence
ucucuuuaucccugagguguca

SEQ ID NO: 5541 - RNA, 22 nt, Artificial Sequence
  Guide Sequence
ucuguccagaucucuuuauccc

SEQ ID NO: 5542 - RNA, 22 nt, Artificial Sequence
  Guide Sequence
ucuuuaucccugaggugucagu

SEQ ID NO: 5543 - RNA, 22 nt, Artificial Sequence
  Guide Sequence
ugacaccucagggauaaagaga

SEQ ID NO: 5544 - RNA, 22 nt, Artificial Sequence
  Guide Sequence
uguccagaucucuuuaucccug

SEQ ID NO: 5545 - RNA, 22 nt, Artificial Sequence
  Guide Sequence
uuaucccugaggugucaguuug

SEQ ID NO: 5546 - RNA, 22 nt, Artificial Sequence
  Guide Sequence
uucuguccagaucucuuuaucc

SEQ ID NO: 5547 - RNA, 22 nt, Artificial Sequence
  Guide Sequence
uuuaucccugaggugucaguuu

SEQ ID NO: 5548 - RNA, 20 nt, Artificial Sequence
  Guide Sequence
aaacgcaggccuuaccuguc

SEQ ID NO: 5549 - RNA, 20 nt, Artificial Sequence
  Guide Sequence
aaagagaucuggacagaauc

SEQ ID NO: 5550 - RNA, 20 nt, Artificial Sequence
  Guide Sequence
aacgcaggccuuaccuguca

SEQ ID NO: 5551 - RNA, 20 nt, Artificial Sequence
  Guide Sequence
aagagaucuggacagaaucg

SEQ ID NO: 5552 - RNA, 20 nt, Artificial Sequence
  Guide Sequence
aaucgccugacagguaaggc

SEQ ID NO: 5553 - RNA, 20 nt, Artificial Sequence
  Guide Sequence
acagaaucgccugacaggua

SEQ ID NO: 5554 - RNA, 20 nt, Artificial Sequence
  Guide Sequence
accugucaggcgauucuguc

SEQ ID NO: 5555 - RNA, 20 nt, Artificial Sequence
  Guide Sequence
acgcaggccuuaccugucag

SEQ ID NO: 5556 - RNA, 20 nt, Artificial Sequence
  Guide Sequence
agaaucgccugacagguaag

SEQ ID NO: 5557 - RNA, 20 nt, Artificial Sequence
  Guide Sequence
agagaucuggacagaaucgc

SEQ ID NO: 5558 - RNA, 20 nt, Artificial Sequence
  Guide Sequence
agaucuggacagaaucgccu

SEQ ID NO: 5559 - RNA, 20 nt, Artificial Sequence
  Guide Sequence
aggccuuaccugucaggcga

SEQ ID NO: 5560 - RNA, 20 nt, Artificial Sequence
  Guide Sequence
aucgccugacagguaaggcc

SEQ ID NO: 5561 - RNA, 20 nt, Artificial Sequence
  Guide Sequence
aucuggacagaaucgccuga

SEQ ID NO: 5562 - RNA, 20 nt, Artificial Sequence
  Guide Sequence
caaacgcaggccuuaccugu

SEQ ID NO: 5563 - RNA, 20 nt, Artificial Sequence
  Guide Sequence
cagaaucgccugacagguaa

SEQ ID NO: 5564 - RNA, 20 nt, Artificial Sequence
  Guide Sequence
caggccuuaccugucaggcg

SEQ ID NO: 5565 - RNA, 20 nt, Artificial Sequence
  Guide Sequence
caggcgauucuguccagauc

SEQ ID NO: 5566 - RNA, 20 nt, Artificial Sequence
  Guide Sequence
ccaaacgcaggccuuaccug

SEQ ID NO: 5567 - RNA, 20 nt, Artificial Sequence
  Guide Sequence
cccaaacgcaggccuuaccu

SEQ ID NO: 5568 - RNA, 20 nt, Artificial Sequence
  Guide Sequence
ccugacagguaaggccugcg

SEQ ID NO: 5569 - RNA, 20 nt, Artificial Sequence
  Guide Sequence
ccugucaggcgauucugucc

SEQ ID NO: 5570 - RNA, 20 nt, Artificial Sequence
  Guide Sequence
ccuuaccugucaggcgauuc

SEQ ID NO: 5571 - RNA, 20 nt, Artificial Sequence
  Guide Sequence
cgcaggccuuaccugucagg

SEQ ID NO: 5572 - RNA, 20 nt, Artificial Sequence
  Guide Sequence
cgccugacagguaaggccug

SEQ ID NO: 5573 - RNA, 20 nt, Artificial Sequence
  Guide Sequence
cugacagguaaggccugcgu

SEQ ID NO: 5574 - RNA, 20 nt, Artificial Sequence
  Guide Sequence
cuggacagaaucgccugaca

SEQ ID NO: 5575 - RNA, 20 nt, Artificial Sequence
  Guide Sequence
cugucaggcgauucugucca

SEQ ID NO: 5576 - RNA, 20 nt, Artificial Sequence
  Guide Sequence
cuuaccugucaggcgauucu

SEQ ID NO: 5577 - RNA, 20 nt, Artificial Sequence
  Guide Sequence
gaaucgccugacagguaagg

SEQ ID NO: 5578 - RNA, 20 nt, Artificial Sequence
  Guide Sequence
gacagaaucgccugacaggu

SEQ ID NO: 5579 - RNA, 20 nt, Artificial Sequence
  Guide Sequence
gagaucuggacagaaucgcc

SEQ ID NO: 5580 - RNA, 20 nt, Artificial Sequence
  Guide Sequence
gaucuggacagaaucgccug

SEQ ID NO: 5581 - RNA, 20 nt, Artificial Sequence
  Guide Sequence
gcaggccuuaccugucaggc

SEQ ID NO: 5582 - RNA, 20 nt, Artificial Sequence
  Guide Sequence
gccugacagguaaggccugc

SEQ ID NO: 5583 - RNA, 20 nt, Artificial Sequence
  Guide Sequence
gccuuaccugucaggcgauu

SEQ ID NO: 5584 - RNA, 20 nt, Artificial Sequence
  Guide Sequence
ggacagaaucgccugacagg

SEQ ID NO: 5585 - RNA, 20 nt, Artificial Sequence
  Guide Sequence
ggccuuaccugucaggcgau

SEQ ID NO: 5586 - RNA, 20 nt, Artificial Sequence
  Guide Sequence
gucaggcgauucuguccaga

SEQ ID NO: 5587 - RNA, 20 nt, Artificial Sequence
  Guide Sequence
uaccugucaggcgauucugu

SEQ ID NO: 5588 - RNA, 20 nt, Artificial Sequence
  Guide Sequence
ucaggcgauucuguccagau

SEQ ID NO: 5589 - RNA, 20 nt, Artificial Sequence
  Guide Sequence
ucgccugacagguaaggccu

SEQ ID NO: 5590 - RNA, 20 nt, Artificial Sequence
  Guide Sequence
ucuggacagaaucgccugac

SEQ ID NO: 5591 - RNA, 20 nt, Artificial Sequence
  Guide Sequence
uggacagaaucgccugacag

SEQ ID NO: 5592 - RNA, 20 nt, Artificial Sequence
  Guide Sequence
ugucaggcgauucuguccag

SEQ ID NO: 5593 - RNA, 20 nt, Artificial Sequence
  Guide Sequence
uuaccugucaggcgauucug

SEQ ID NO: 5594 - RNA, 21 nt, Artificial Sequence
  Guide Sequence
aaacgcaggccuuaccuguca

SEQ ID NO: 5595 - RNA, 21 nt, Artificial Sequence
  Guide Sequence
aaagagaucuggacagaaucg

SEQ ID NO: 5596 - RNA, 21 nt, Artificial Sequence
  Guide Sequence
aacgcaggccuuaccugucag

SEQ ID NO: 5597 - RNA, 21 nt, Artificial Sequence
  Guide Sequence
aagagaucuggacagaaucgc

SEQ ID NO: 5598 - RNA, 21 nt, Artificial Sequence
  Guide Sequence
aaucgccugacagguaaggcc

SEQ ID NO: 5599 - RNA, 21 nt, Artificial Sequence
  Guide Sequence
acagaaucgccugacagguaa

SEQ ID NO: 5600 - RNA, 21 nt, Artificial Sequence
  Guide Sequence
accugucaggcgauucugucc

SEQ ID NO: 5601 - RNA, 21 nt, Artificial Sequence
  Guide Sequence
acgcaggccuuaccugucagg

SEQ ID NO: 5602 - RNA, 21 nt, Artificial Sequence
  Guide Sequence
agaaucgccugacagguaagg

SEQ ID NO: 5603 - RNA, 21 nt, Artificial Sequence
  Guide Sequence
agagaucuggacagaaucgcc

SEQ ID NO: 5604 - RNA, 21 nt, Artificial Sequence
  Guide Sequence
agaucuggacagaaucgccug

SEQ ID NO: 5605 - RNA, 21 nt, Artificial Sequence
  Guide Sequence
aggccuuaccugucaggcgau

SEQ ID NO: 5606 - RNA, 21 nt, Artificial Sequence
  Guide Sequence
aucgccugacagguaaggccu

SEQ ID NO: 5607 - RNA, 21 nt, Artificial Sequence
  Guide Sequence
aucuggacagaaucgccugac

SEQ ID NO: 5608 - RNA, 21 nt, Artificial Sequence
  Guide Sequence
caaacgcaggccuuaccuguc

SEQ ID NO: 5609 - RNA, 21 nt, Artificial Sequence
  Guide Sequence
caaagagaucuggacagaauc

SEQ ID NO: 5610 - RNA, 21 nt, Artificial Sequence
  Guide Sequence
cagaaucgccugacagguaag

SEQ ID NO: 5611 - RNA, 21 nt, Artificial Sequence
  Guide Sequence
caggccuuaccugucaggcga

SEQ ID NO: 5612 - RNA, 21 nt, Artificial Sequence
  Guide Sequence
caggcgauucuguccagaucu

SEQ ID NO: 5613 - RNA, 21 nt, Artificial Sequence
  Guide Sequence
ccaaacgcaggccuuaccugu

SEQ ID NO: 5614 - RNA, 21 nt, Artificial Sequence
  Guide Sequence
cccaaacgcaggccuuaccug

SEQ ID NO: 5615 - RNA, 21 nt, Artificial Sequence
  Guide Sequence
ccccaaacgcaggccuuaccu

SEQ ID NO: 5616 - RNA, 21 nt, Artificial Sequence
  Guide Sequence
ccugacagguaaggccugcgu

SEQ ID NO: 5617 - RNA, 21 nt, Artificial Sequence
  Guide Sequence
ccugucaggcgauucugucca

SEQ ID NO: 5618 - RNA, 21 nt, Artificial Sequence
  Guide Sequence
ccuuaccugucaggcgauucu

SEQ ID NO: 5619 - RNA, 21 nt, Artificial Sequence
  Guide Sequence
cgcaggccuuaccugucaggc

SEQ ID NO: 5620 - RNA, 21 nt, Artificial Sequence
  Guide Sequence
cgccugacagguaaggccugc

SEQ ID NO: 5621 - RNA, 21 nt, Artificial Sequence
  Guide Sequence
cugacagguaaggccugcguu

SEQ ID NO: 5622 - RNA, 21 nt, Artificial Sequence
  Guide Sequence
cuggacagaaucgccugacag

SEQ ID NO: 5623 - RNA, 21 nt, Artificial Sequence
  Guide Sequence
cugucaggcgauucuguccag

SEQ ID NO: 5624 - RNA, 21 nt, Artificial Sequence
  Guide Sequence
cuuaccugucaggcgauucug

SEQ ID NO: 5625 - RNA, 21 nt, Artificial Sequence
  Guide Sequence
gaaucgccugacagguaaggc

SEQ ID NO: 5626 - RNA, 21 nt, Artificial Sequence
  Guide Sequence
gacagaaucgccugacaggua

SEQ ID NO: 5627 - RNA, 21 nt, Artificial Sequence
  Guide Sequence
gagaucuggacagaaucgccu

SEQ ID NO: 5628 - RNA, 21 nt, Artificial Sequence
  Guide Sequence
gaucuggacagaaucgccuga

SEQ ID NO: 5629 - RNA, 21 nt, Artificial Sequence
  Guide Sequence
gcaggccuuaccugucaggcg

SEQ ID NO: 5630 - RNA, 21 nt, Artificial Sequence
  Guide Sequence
gccugacagguaaggccugcg

SEQ ID NO: 5631 - RNA, 21 nt, Artificial Sequence
  Guide Sequence
gccuuaccugucaggcgauuc

SEQ ID NO: 5632 - RNA, 21 nt, Artificial Sequence
  Guide Sequence
ggacagaaucgccugacaggu

SEQ ID NO: 5633 - RNA, 21 nt, Artificial Sequence
  Guide Sequence
ggccuuaccugucaggcgauu

SEQ ID NO: 5634 - RNA, 21 nt, Artificial Sequence
  Guide Sequence
gucaggcgauucuguccagau

SEQ ID NO: 5635 - RNA, 21 nt, Artificial Sequence
  Guide Sequence
uaccugucaggcgauucuguc

SEQ ID NO: 5636 - RNA, 21 nt, Artificial Sequence
  Guide Sequence
ucaggcgauucuguccagauc

SEQ ID NO: 5637 - RNA, 21 nt, Artificial Sequence
  Guide Sequence
ucgccugacagguaaggccug

SEQ ID NO: 5638 - RNA, 21 nt, Artificial Sequence
  Guide Sequence
ucuggacagaaucgccugaca

SEQ ID NO: 5639 - RNA, 21 nt, Artificial Sequence
  Guide Sequence
uggacagaaucgccugacagg

SEQ ID NO: 5640 - RNA, 21 nt, Artificial Sequence
  Guide Sequence
ugucaggcgauucuguccaga

SEQ ID NO: 5641 - RNA, 21 nt, Artificial Sequence
  Guide Sequence
uuaccugucaggcgauucugu

SEQ ID NO: 5642 - RNA, 22 nt, Artificial Sequence
  Guide Sequence
aaacgcaggccuuaccugucag

SEQ ID NO: 5643 - RNA, 22 nt, Artificial Sequence
  Guide Sequence
aaagagaucuggacagaaucgc

SEQ ID NO: 5644 - RNA, 22 nt, Artificial Sequence
  Guide Sequence
aacgcaggccuuaccugucagg

SEQ ID NO: 5645 - RNA, 22 nt, Artificial Sequence
  Guide Sequence
aagagaucuggacagaaucgcc

SEQ ID NO: 5646 - RNA, 22 nt, Artificial Sequence
  Guide Sequence
aaucgccugacagguaaggccu

SEQ ID NO: 5647 - RNA, 22 nt, Artificial Sequence
  Guide Sequence
acaaagagaucuggacagaauc

SEQ ID NO: 5648 - RNA, 22 nt, Artificial Sequence
  Guide Sequence
acagaaucgccugacagguaag

SEQ ID NO: 5649 - RNA, 22 nt, Artificial Sequence
  Guide Sequence
accccaaacgcaggccuuaccu

SEQ ID NO: 5650 - RNA, 22 nt, Artificial Sequence
  Guide Sequence
accugucaggcgauucugucca

SEQ ID NO: 5651 - RNA, 22 nt, Artificial Sequence
  Guide Sequence
acgcaggccuuaccugucaggc

SEQ ID NO: 5652 - RNA, 22 nt, Artificial Sequence
  Guide Sequence
agaaucgccugacagguaaggc

SEQ ID NO: 5653 - RNA, 22 nt, Artificial Sequence
  Guide Sequence
agagaucuggacagaaucgccu

SEQ ID NO: 5654 - RNA, 22 nt, Artificial Sequence
  Guide Sequence
agaucuggacagaaucgccuga

SEQ ID NO: 5655 - RNA, 22 nt, Artificial Sequence
  Guide Sequence
aggccuuaccugucaggcgauu

SEQ ID NO: 5656 - RNA, 22 nt, Artificial Sequence
  Guide Sequence
aucgccugacagguaaggccug

SEQ ID NO: 5657 - RNA, 22 nt, Artificial Sequence
  Guide Sequence
aucuggacagaaucgccugaca

SEQ ID NO: 5658 - RNA, 22 nt, Artificial Sequence
  Guide Sequence
caaacgcaggccuuaccuguca

SEQ ID NO: 5659 - RNA, 22 nt, Artificial Sequence
  Guide Sequence
caaagagaucuggacagaaucg

SEQ ID NO: 5660 - RNA, 22 nt, Artificial Sequence
  Guide Sequence
cagaaucgccugacagguaagg

SEQ ID NO: 5661 - RNA, 22 nt, Artificial Sequence
  Guide Sequence
caggccuuaccugucaggcgau

SEQ ID NO: 5662 - RNA, 22 nt, Artificial Sequence
  Guide Sequence
caggcgauucuguccagaucuc

SEQ ID NO: 5663 - RNA, 22 nt, Artificial Sequence
  Guide Sequence
ccaaacgcaggccuuaccuguc

SEQ ID NO: 5664 - RNA, 22 nt, Artificial Sequence
  Guide Sequence
cccaaacgcaggccuuaccugu

SEQ ID NO: 5665 - RNA, 22 nt, Artificial Sequence
  Guide Sequence
ccccaaacgcaggccuuaccug

SEQ ID NO: 5666 - RNA, 22 nt, Artificial Sequence
  Guide Sequence
ccugacagguaaggccugcguu

SEQ ID NO: 5667 - RNA, 22 nt, Artificial Sequence
  Guide Sequence
ccugucaggcgauucuguccag

SEQ ID NO: 5668 - RNA, 22 nt, Artificial Sequence
  Guide Sequence
ccuuaccugucaggcgauucug

SEQ ID NO: 5669 - RNA, 22 nt, Artificial Sequence
  Guide Sequence
cgcaggccuuaccugucaggcg

SEQ ID NO: 5670 - RNA, 22 nt, Artificial Sequence
  Guide Sequence
cgccugacagguaaggccugcg

SEQ ID NO: 5671 - RNA, 22 nt, Artificial Sequence
  Guide Sequence
cugacagguaaggccugcguuu

SEQ ID NO: 5672 - RNA, 22 nt, Artificial Sequence
  Guide Sequence
cuggacagaaucgccugacagg

SEQ ID NO: 5673 - RNA, 22 nt, Artificial Sequence
  Guide Sequence
cugucaggcgauucuguccaga

SEQ ID NO: 5674 - RNA, 22 nt, Artificial Sequence
  Guide Sequence
cuuaccugucaggcgauucugu

SEQ ID NO: 5675 - RNA, 22 nt, Artificial Sequence
  Guide Sequence
gaaucgccugacagguaaggcc

SEQ ID NO: 5676 - RNA, 22 nt, Artificial Sequence
  Guide Sequence
gacagaaucgccugacagguaa

SEQ ID NO: 5677 - RNA, 22 nt, Artificial Sequence
  Guide Sequence
gagaucuggacagaaucgccug

SEQ ID NO: 5678 - RNA, 22 nt, Artificial Sequence
  Guide Sequence
gaucuggacagaaucgccugac

SEQ ID NO: 5679 - RNA, 22 nt, Artificial Sequence
  Guide Sequence
gcaggccuuaccugucaggcga

SEQ ID NO: 5680 - RNA, 22 nt, Artificial Sequence
  Guide Sequence
gccugacagguaaggccugcgu

SEQ ID NO: 5681 - RNA, 22 nt, Artificial Sequence
  Guide Sequence
gccuuaccugucaggcgauucu

SEQ ID NO: 5682 - RNA, 22 nt, Artificial Sequence
  Guide Sequence
ggacagaaucgccugacaggua

SEQ ID NO: 5683 - RNA, 22 nt, Artificial Sequence
  Guide Sequence
ggccuuaccugucaggcgauuc

SEQ ID NO: 5684 - RNA, 22 nt, Artificial Sequence
  Guide Sequence
gucaggcgauucuguccagauc

SEQ ID NO: 5685 - RNA, 22 nt, Artificial Sequence
  Guide Sequence
uaccugucaggcgauucugucc

SEQ ID NO: 5686 - RNA, 22 nt, Artificial Sequence
  Guide Sequence
ucaggcgauucuguccagaucu

SEQ ID NO: 5687 - RNA, 22 nt, Artificial Sequence
  Guide Sequence
ucgccugacagguaaggccugc

SEQ ID NO: 5688 - RNA, 22 nt, Artificial Sequence
  Guide Sequence
ucuggacagaaucgccugacag

SEQ ID NO: 5689 - RNA, 22 nt, Artificial Sequence
  Guide Sequence
uggacagaaucgccugacaggu

SEQ ID NO: 5690 - RNA, 22 nt, Artificial Sequence
  Guide Sequence
ugucaggcgauucuguccagau

SEQ ID NO: 5691 - RNA, 22 nt, Artificial Sequence
  Guide Sequence
uuaccugucaggcgauucuguc

SEQ ID NO: 5692 - RNA, 20 nt, Artificial Sequence
  Guide Sequence
aaacgcaggccuuacccguc

SEQ ID NO: 5693 - RNA, 20 nt, Artificial Sequence
  Guide Sequence
aacgcaggccuuacccgucc

SEQ ID NO: 5694 - RNA, 20 nt, Artificial Sequence
  Guide Sequence
aaucgccggacggguaaggc

SEQ ID NO: 5695 - RNA, 20 nt, Artificial Sequence
  Guide Sequence
acagaaucgccggacgggua

SEQ ID NO: 5696 - RNA, 20 nt, Artificial Sequence
  Guide Sequence
accccaaacgcaggccuuac

SEQ ID NO: 5697 - RNA, 20 nt, Artificial Sequence
  Guide Sequence
acccguccggcgauucuguc

SEQ ID NO: 5698 - RNA, 20 nt, Artificial Sequence
  Guide Sequence
acgcaggccuuacccguccg

SEQ ID NO: 5699 - RNA, 20 nt, Artificial Sequence
  Guide Sequence
acggguaaggccugcguuug

SEQ ID NO: 5700 - RNA, 20 nt, Artificial Sequence
  Guide Sequence
agaaucgccggacggguaag

SEQ ID NO: 5701 - RNA, 20 nt, Artificial Sequence
  Guide Sequence
agaucuggacagaaucgccg

SEQ ID NO: 5702 - RNA, 20 nt, Artificial Sequence
  Guide Sequence
aggccuuacccguccggcga

SEQ ID NO: 5703 - RNA, 20 nt, Artificial Sequence
  Guide Sequence
aucgccggacggguaaggcc

SEQ ID NO: 5704 - RNA, 20 nt, Artificial Sequence
  Guide Sequence
aucuggacagaaucgccgga

SEQ ID NO: 5705 - RNA, 20 nt, Artificial Sequence
  Guide Sequence
caaacgcaggccuuacccgu

SEQ ID NO: 5706 - RNA, 20 nt, Artificial Sequence
  Guide Sequence
caccccaaacgcaggccuua

SEQ ID NO: 5707 - RNA, 20 nt, Artificial Sequence
  Guide Sequence
cagaaucgccggacggguaa

SEQ ID NO: 5708 - RNA, 20 nt, Artificial Sequence
  Guide Sequence
caggccuuacccguccggcg

SEQ ID NO: 5709 - RNA, 20 nt, Artificial Sequence
  Guide Sequence
ccaaacgcaggccuuacccg

SEQ ID NO: 5710 - RNA, 20 nt, Artificial Sequence
  Guide Sequence
ccaccccaaacgcaggccuu

SEQ ID NO: 5711 - RNA, 20 nt, Artificial Sequence
  Guide Sequence
cccaaacgcaggccuuaccc

SEQ ID NO: 5712 - RNA, 20 nt, Artificial Sequence
  Guide Sequence
ccccaaacgcaggccuuacc

SEQ ID NO: 5713 - RNA, 20 nt, Artificial Sequence
  Guide Sequence
cccguccggcgauucugucc

SEQ ID NO: 5714 - RNA, 20 nt, Artificial Sequence
  Guide Sequence
ccggacggguaaggccugcg

SEQ ID NO: 5715 - RNA, 20 nt, Artificial Sequence
  Guide Sequence
ccguccggcgauucugucca

SEQ ID NO: 5716 - RNA, 20 nt, Artificial Sequence
  Guide Sequence
ccuuacccguccggcgauuc

SEQ ID NO: 5717 - RNA, 20 nt, Artificial Sequence
  Guide Sequence
cgcaggccuuacccguccgg

SEQ ID NO: 5718 - RNA, 20 nt, Artificial Sequence
  Guide Sequence
cgccggacggguaaggccug

SEQ ID NO: 5719 - RNA, 20 nt, Artificial Sequence
  Guide Sequence
cggacggguaaggccugcgu

SEQ ID NO: 5720 - RNA, 20 nt, Artificial Sequence
  Guide Sequence
cggguaaggccugcguuugg

SEQ ID NO: 5721 - RNA, 20 nt, Artificial Sequence
  Guide Sequence
cuggacagaaucgccggacg

SEQ ID NO: 5722 - RNA, 20 nt, Artificial Sequence
  Guide Sequence
cuuacccguccggcgauucu

SEQ ID NO: 5723 - RNA, 20 nt, Artificial Sequence
  Guide Sequence
gaaucgccggacggguaagg

SEQ ID NO: 5724 - RNA, 20 nt, Artificial Sequence
  Guide Sequence
gacagaaucgccggacgggu

SEQ ID NO: 5725 - RNA, 20 nt, Artificial Sequence
  Guide Sequence
gacggguaaggccugcguuu

SEQ ID NO: 5726 - RNA, 20 nt, Artificial Sequence
  Guide Sequence
gaucuggacagaaucgccgg

SEQ ID NO: 5727 - RNA, 20 nt, Artificial Sequence
  Guide Sequence
gcaggccuuacccguccggc

SEQ ID NO: 5728 - RNA, 20 nt, Artificial Sequence
  Guide Sequence
gccggacggguaaggccugc

SEQ ID NO: 5729 - RNA, 20 nt, Artificial Sequence
  Guide Sequence
gccuuacccguccggcgauu

SEQ ID NO: 5730 - RNA, 20 nt, Artificial Sequence
  Guide Sequence
ggacagaaucgccggacggg

SEQ ID NO: 5731 - RNA, 20 nt, Artificial Sequence
  Guide Sequence
ggacggguaaggccugcguu

SEQ ID NO: 5732 - RNA, 20 nt, Artificial Sequence
  Guide Sequence
ggccuuacccguccggcgau

SEQ ID NO: 5733 - RNA, 20 nt, Artificial Sequence
  Guide Sequence
uacccguccggcgauucugu

SEQ ID NO: 5734 - RNA, 20 nt, Artificial Sequence
  Guide Sequence
ucgccggacggguaaggccu

SEQ ID NO: 5735 - RNA, 20 nt, Artificial Sequence
  Guide Sequence
ucuggacagaaucgccggac

SEQ ID NO: 5736 - RNA, 20 nt, Artificial Sequence
  Guide Sequence
uggacagaaucgccggacgg

SEQ ID NO: 5737 - RNA, 20 nt, Artificial Sequence
  Guide Sequence
uuacccguccggcgauucug

SEQ ID NO: 5738 - RNA, 21 nt, Artificial Sequence
  Guide Sequence
aaacgcaggccuuacccgucc

SEQ ID NO: 5739 - RNA, 21 nt, Artificial Sequence
  Guide Sequence
aacgcaggccuuacccguccg

SEQ ID NO: 5740 - RNA, 21 nt, Artificial Sequence
  Guide Sequence
aaucgccggacggguaaggcc

SEQ ID NO: 5741 - RNA, 21 nt, Artificial Sequence
  Guide Sequence
acagaaucgccggacggguaa

SEQ ID NO: 5742 - RNA, 21 nt, Artificial Sequence
  Guide Sequence
accccaaacgcaggccuuacc

SEQ ID NO: 5743 - RNA, 21 nt, Artificial Sequence
  Guide Sequence
acccguccggcgauucugucc

SEQ ID NO: 5744 - RNA, 21 nt, Artificial Sequence
  Guide Sequence
acgcaggccuuacccguccgg

SEQ ID NO: 5745 - RNA, 21 nt, Artificial Sequence
  Guide Sequence
acggguaaggccugcguuugg

SEQ ID NO: 5746 - RNA, 21 nt, Artificial Sequence
  Guide Sequence
agaaucgccggacggguaagg

SEQ ID NO: 5747 - RNA, 21 nt, Artificial Sequence
  Guide Sequence
agaucuggacagaaucgccgg

SEQ ID NO: 5748 - RNA, 21 nt, Artificial Sequence
  Guide Sequence
aggccuuacccguccggcgau

SEQ ID NO: 5749 - RNA, 21 nt, Artificial Sequence
  Guide Sequence
aucgccggacggguaaggccu

SEQ ID NO: 5750 - RNA, 21 nt, Artificial Sequence
  Guide Sequence
aucuggacagaaucgccggac

SEQ ID NO: 5751 - RNA, 21 nt, Artificial Sequence
  Guide Sequence
caaacgcaggccuuacccguc

SEQ ID NO: 5752 - RNA, 21 nt, Artificial Sequence
  Guide Sequence
caccccaaacgcaggccuuac

SEQ ID NO: 5753 - RNA, 21 nt, Artificial Sequence
  Guide Sequence
cagaaucgccggacggguaag

SEQ ID NO: 5754 - RNA, 21 nt, Artificial Sequence
  Guide Sequence
caggccuuacccguccggcga

SEQ ID NO: 5755 - RNA, 21 nt, Artificial Sequence
  Guide Sequence
ccaaacgcaggccuuacccgu

SEQ ID NO: 5756 - RNA, 21 nt, Artificial Sequence
  Guide Sequence
ccaccccaaacgcaggccuua

SEQ ID NO: 5757 - RNA, 21 nt, Artificial Sequence
  Guide Sequence
cccaaacgcaggccuuacccg

SEQ ID NO: 5758 - RNA, 21 nt, Artificial Sequence
  Guide Sequence
cccaccccaaacgcaggccuu

SEQ ID NO: 5759 - RNA, 21 nt, Artificial Sequence
  Guide Sequence
ccccaaacgcaggccuuaccc

SEQ ID NO: 5760 - RNA, 21 nt, Artificial Sequence
  Guide Sequence
cccguccggcgauucugucca

SEQ ID NO: 5761 - RNA, 21 nt, Artificial Sequence
  Guide Sequence
ccggacggguaaggccugcgu

SEQ ID NO: 5762 - RNA, 21 nt, Artificial Sequence
  Guide Sequence
ccguccggcgauucuguccag

SEQ ID NO: 5763 - RNA, 21 nt, Artificial Sequence
  Guide Sequence
ccuuacccguccggcgauucu

SEQ ID NO: 5764 - RNA, 21 nt, Artificial Sequence
  Guide Sequence
cgcaggccuuacccguccggc

SEQ ID NO: 5765 - RNA, 21 nt, Artificial Sequence
  Guide Sequence
cgccggacggguaaggccugc

SEQ ID NO: 5766 - RNA, 21 nt, Artificial Sequence
  Guide Sequence
cggacggguaaggccugcguu

SEQ ID NO: 5767 - RNA, 21 nt, Artificial Sequence
  Guide Sequence
cggguaaggccugcguuuggg

SEQ ID NO: 5768 - RNA, 21 nt, Artificial Sequence
  Guide Sequence
cuggacagaaucgccggacgg

SEQ ID NO: 5769 - RNA, 21 nt, Artificial Sequence
  Guide Sequence
cuuacccguccggcgauucug

SEQ ID NO: 5770 - RNA, 21 nt, Artificial Sequence
  Guide Sequence
gaaucgccggacggguaaggc

SEQ ID NO: 5771 - RNA, 21 nt, Artificial Sequence
  Guide Sequence
gacagaaucgccggacgggua

SEQ ID NO: 5772 - RNA, 21 nt, Artificial Sequence
  Guide Sequence
gacggguaaggccugcguuug

SEQ ID NO: 5773 - RNA, 21 nt, Artificial Sequence
  Guide Sequence
gagaucuggacagaaucgccg

SEQ ID NO: 5774 - RNA, 21 nt, Artificial Sequence
  Guide Sequence
gaucuggacagaaucgccgga

SEQ ID NO: 5775 - RNA, 21 nt, Artificial Sequence
  Guide Sequence
gcaggccuuacccguccggcg

SEQ ID NO: 5776 - RNA, 21 nt, Artificial Sequence
  Guide Sequence
gccggacggguaaggccugcg

SEQ ID NO: 5777 - RNA, 21 nt, Artificial Sequence
  Guide Sequence
gccuuacccguccggcgauuc

SEQ ID NO: 5778 - RNA, 21 nt, Artificial Sequence
  Guide Sequence
ggacagaaucgccggacgggu

SEQ ID NO: 5779 - RNA, 21 nt, Artificial Sequence
  Guide Sequence
ggacggguaaggccugcguuu

SEQ ID NO: 5780 - RNA, 21 nt, Artificial Sequence
  Guide Sequence
ggccuuacccguccggcgauu

SEQ ID NO: 5781 - RNA, 21 nt, Artificial Sequence
  Guide Sequence
uacccguccggcgauucuguc

SEQ ID NO: 5782 - RNA, 21 nt, Artificial Sequence
  Guide Sequence
ucgccggacggguaaggccug

SEQ ID NO: 5783 - RNA, 21 nt, Artificial Sequence
  Guide Sequence
ucuggacagaaucgccggacg

SEQ ID NO: 5784 - RNA, 21 nt, Artificial Sequence
  Guide Sequence
uggacagaaucgccggacggg

SEQ ID NO: 5785 - RNA, 21 nt, Artificial Sequence
  Guide Sequence
uuacccguccggcgauucugu

SEQ ID NO: 5786 - RNA, 22 nt, Artificial Sequence
  Guide Sequence
aaacgcaggccuuacccguccg

SEQ ID NO: 5787 - RNA, 22 nt, Artificial Sequence
  Guide Sequence
aacgcaggccuuacccguccgg

SEQ ID NO: 5788 - RNA, 22 nt, Artificial Sequence
  Guide Sequence
aaucgccggacggguaaggccu

SEQ ID NO: 5789 - RNA, 22 nt, Artificial Sequence
  Guide Sequence
acagaaucgccggacggguaag

SEQ ID NO: 5790 - RNA, 22 nt, Artificial Sequence
  Guide Sequence
accccaaacgcaggccuuaccc

SEQ ID NO: 5791 - RNA, 22 nt, Artificial Sequence
  Guide Sequence
acccguccggcgauucugucca

SEQ ID NO: 5792 - RNA, 22 nt, Artificial Sequence
  Guide Sequence
acgcaggccuuacccguccggc

SEQ ID NO: 5793 - RNA, 22 nt, Artificial Sequence
  Guide Sequence
acggguaaggccugcguuuggg

SEQ ID NO: 5794 - RNA, 22 nt, Artificial Sequence
  Guide Sequence
agaaucgccggacggguaaggc

SEQ ID NO: 5795 - RNA, 22 nt, Artificial Sequence
  Guide Sequence
agagaucuggacagaaucgccg

SEQ ID NO: 5796 - RNA, 22 nt, Artificial Sequence
  Guide Sequence
agaucuggacagaaucgccgga

SEQ ID NO: 5797 - RNA, 22 nt, Artificial Sequence
  Guide Sequence
aggccuuacccguccggcgauu

SEQ ID NO: 5798 - RNA, 22 nt, Artificial Sequence
  Guide Sequence
aucgccggacggguaaggccug

SEQ ID NO: 5799 - RNA, 22 nt, Artificial Sequence
  Guide Sequence
aucuggacagaaucgccggacg

SEQ ID NO: 5800 - RNA, 22 nt, Artificial Sequence
  Guide Sequence
caaacgcaggccuuacccgucc

SEQ ID NO: 5801 - RNA, 22 nt, Artificial Sequence
  Guide Sequence
caccccaaacgcaggccuuacc

SEQ ID NO: 5802 - RNA, 22 nt, Artificial Sequence
  Guide Sequence
cagaaucgccggacggguaagg

SEQ ID NO: 5803 - RNA, 22 nt, Artificial Sequence
  Guide Sequence
caggccuuacccguccggcgau

SEQ ID NO: 5804 - RNA, 22 nt, Artificial Sequence
  Guide Sequence
ccaaacgcaggccuuacccguc

SEQ ID NO: 5805 - RNA, 22 nt, Artificial Sequence
  Guide Sequence
ccaccccaaacgcaggccuuac

SEQ ID NO: 5806 - RNA, 22 nt, Artificial Sequence
  Guide Sequence
cccaaacgcaggccuuacccgu

SEQ ID NO: 5807 - RNA, 22 nt, Artificial Sequence
  Guide Sequence
cccaccccaaacgcaggccuua

SEQ ID NO: 5808 - RNA, 22 nt, Artificial Sequence
  Guide Sequence
ccccaaacgcaggccuuacccg

SEQ ID NO: 5809 - RNA, 22 nt, Artificial Sequence
  Guide Sequence
ccccaccccaaacgcaggccuu

SEQ ID NO: 5810 - RNA, 22 nt, Artificial Sequence
  Guide Sequence
cccguccggcgauucuguccag

SEQ ID NO: 5811 - RNA, 22 nt, Artificial Sequence
  Guide Sequence
ccggacggguaaggccugcguu

SEQ ID NO: 5812 - RNA, 22 nt, Artificial Sequence
  Guide Sequence
ccguccggcgauucuguccaga

SEQ ID NO: 5813 - RNA, 22 nt, Artificial Sequence
  Guide Sequence
ccuuacccguccggcgauucug

SEQ ID NO: 5814 - RNA, 22 nt, Artificial Sequence
  Guide Sequence
cgcaggccuuacccguccggcg

SEQ ID NO: 5815 - RNA, 22 nt, Artificial Sequence
  Guide Sequence
cgccggacggguaaggccugcg

SEQ ID NO: 5816 - RNA, 22 nt, Artificial Sequence
  Guide Sequence
cggacggguaaggccugcguuu

SEQ ID NO: 5817 - RNA, 22 nt, Artificial Sequence
  Guide Sequence
cggguaaggccugcguuugggg

SEQ ID NO: 5818 - RNA, 22 nt, Artificial Sequence
  Guide Sequence
cuggacagaaucgccggacggg

SEQ ID NO: 5819 - RNA, 22 nt, Artificial Sequence
  Guide Sequence
cuuacccguccggcgauucugu

SEQ ID NO: 5820 - RNA, 22 nt, Artificial Sequence
  Guide Sequence
gaaucgccggacggguaaggcc

SEQ ID NO: 5821 - RNA, 22 nt, Artificial Sequence
  Guide Sequence
gacagaaucgccggacggguaa

SEQ ID NO: 5822 - RNA, 22 nt, Artificial Sequence
  Guide Sequence
gacggguaaggccugcguuugg

SEQ ID NO: 5823 - RNA, 22 nt, Artificial Sequence
  Guide Sequence
gagaucuggacagaaucgccgg

SEQ ID NO: 5824 - RNA, 22 nt, Artificial Sequence
  Guide Sequence
gaucuggacagaaucgccggac

SEQ ID NO: 5825 - RNA, 22 nt, Artificial Sequence
  Guide Sequence
gcaggccuuacccguccggcga

SEQ ID NO: 5826 - RNA, 22 nt, Artificial Sequence
  Guide Sequence
gccggacggguaaggccugcgu

SEQ ID NO: 5827 - RNA, 22 nt, Artificial Sequence
  Guide Sequence
gccuuacccguccggcgauucu

SEQ ID NO: 5828 - RNA, 22 nt, Artificial Sequence
  Guide Sequence
ggacagaaucgccggacgggua

SEQ ID NO: 5829 - RNA, 22 nt, Artificial Sequence
  Guide Sequence
ggacggguaaggccugcguuug

SEQ ID NO: 5830 - RNA, 22 nt, Artificial Sequence
  Guide Sequence
ggccuuacccguccggcgauuc

SEQ ID NO: 5831 - RNA, 22 nt, Artificial Sequence
  Guide Sequence
uacccguccggcgauucugucc

SEQ ID NO: 5832 - RNA, 22 nt, Artificial Sequence
  Guide Sequence
ucgccggacggguaaggccugc

SEQ ID NO: 5833 - RNA, 22 nt, Artificial Sequence
  Guide Sequence
ucuggacagaaucgccggacgg

SEQ ID NO: 5834 - RNA, 22 nt, Artificial Sequence
  Guide Sequence
uggacagaaucgccggacgggu

SEQ ID NO: 5835 - RNA, 22 nt, Artificial Sequence
  Guide Sequence
uuacccguccggcgauucuguc

SEQ ID NO: 5836 - RNA, 20 nt, Artificial Sequence
  Guide Sequence
aaacgcaggccuugccuguc

SEQ ID NO: 5837 - RNA, 20 nt, Artificial Sequence
  Guide Sequence
aacgcaggccuugccugucc

SEQ ID NO: 5838 - RNA, 20 nt, Artificial Sequence
  Guide Sequence
aaucgccggacaggcaaggc

SEQ ID NO: 5839 - RNA, 20 nt, Artificial Sequence
  Guide Sequence
acagaaucgccggacaggca

SEQ ID NO: 5840 - RNA, 20 nt, Artificial Sequence
  Guide Sequence
acaggcaaggccugcguuug

SEQ ID NO: 5841 - RNA, 20 nt, Artificial Sequence
  Guide Sequence
accccaaacgcaggccuugc

SEQ ID NO: 5842 - RNA, 20 nt, Artificial Sequence
  Guide Sequence
acgcaggccuugccuguccg

SEQ ID NO: 5843 - RNA, 20 nt, Artificial Sequence
  Guide Sequence
agaaucgccggacaggcaag

SEQ ID NO: 5844 - RNA, 20 nt, Artificial Sequence
  Guide Sequence
aggcaaggccugcguuuggg

SEQ ID NO: 5845 - RNA, 20 nt, Artificial Sequence
  Guide Sequence
aggccuugccuguccggcga

SEQ ID NO: 5846 - RNA, 20 nt, Artificial Sequence
  Guide Sequence
aucgccggacaggcaaggcc

SEQ ID NO: 5847 - RNA, 20 nt, Artificial Sequence
  Guide Sequence
caaacgcaggccuugccugu

SEQ ID NO: 5848 - RNA, 20 nt, Artificial Sequence
  Guide Sequence
caccccaaacgcaggccuug

SEQ ID NO: 5849 - RNA, 20 nt, Artificial Sequence
  Guide Sequence
cagaaucgccggacaggcaa

SEQ ID NO: 5850 - RNA, 20 nt, Artificial Sequence
  Guide Sequence
caggcaaggccugcguuugg

SEQ ID NO: 5851 - RNA, 20 nt, Artificial Sequence
  Guide Sequence
caggccuugccuguccggcg

SEQ ID NO: 5852 - RNA, 20 nt, Artificial Sequence
  Guide Sequence
ccaaacgcaggccuugccug

SEQ ID NO: 5853 - RNA, 20 nt, Artificial Sequence
  Guide Sequence
cccaaacgcaggccuugccu

SEQ ID NO: 5854 - RNA, 20 nt, Artificial Sequence
  Guide Sequence
cccaccccaaacgcaggccu

SEQ ID NO: 5855 - RNA, 20 nt, Artificial Sequence
  Guide Sequence
ccccaaacgcaggccuugcc

SEQ ID NO: 5856 - RNA, 20 nt, Artificial Sequence
  Guide Sequence
ccccaccccaaacgcaggcc

SEQ ID NO: 5857 - RNA, 20 nt, Artificial Sequence
  Guide Sequence
ccggacaggcaaggccugcg

SEQ ID NO: 5858 - RNA, 20 nt, Artificial Sequence
  Guide Sequence
ccuugccuguccggcgauuc

SEQ ID NO: 5859 - RNA, 20 nt, Artificial Sequence
  Guide Sequence
cgcaggccuugccuguccgg

SEQ ID NO: 5860 - RNA, 20 nt, Artificial Sequence
  Guide Sequence
cgccggacaggcaaggccug

SEQ ID NO: 5861 - RNA, 20 nt, Artificial Sequence
  Guide Sequence
cggacaggcaaggccugcgu

SEQ ID NO: 5862 - RNA, 20 nt, Artificial Sequence
  Guide Sequence
cuggacagaaucgccggaca

SEQ ID NO: 5863 - RNA, 20 nt, Artificial Sequence
  Guide Sequence
cuugccuguccggcgauucu

SEQ ID NO: 5864 - RNA, 20 nt, Artificial Sequence
  Guide Sequence
gaaucgccggacaggcaagg

SEQ ID NO: 5865 - RNA, 20 nt, Artificial Sequence
  Guide Sequence
gacagaaucgccggacaggc

SEQ ID NO: 5866 - RNA, 20 nt, Artificial Sequence
  Guide Sequence
gacaggcaaggccugcguuu

SEQ ID NO: 5867 - RNA, 20 nt, Artificial Sequence
  Guide Sequence
gcaaggccugcguuuggggu

SEQ ID NO: 5868 - RNA, 20 nt, Artificial Sequence
  Guide Sequence
gcaggccuugccuguccggc

SEQ ID NO: 5869 - RNA, 20 nt, Artificial Sequence
  Guide Sequence
gccccaccccaaacgcaggc

SEQ ID NO: 5870 - RNA, 20 nt, Artificial Sequence
  Guide Sequence
gccggacaggcaaggccugc

SEQ ID NO: 5871 - RNA, 20 nt, Artificial Sequence
  Guide Sequence
gccuugccuguccggcgauu

SEQ ID NO: 5872 - RNA, 20 nt, Artificial Sequence
  Guide Sequence
ggacagaaucgccggacagg

SEQ ID NO: 5873 - RNA, 20 nt, Artificial Sequence
  Guide Sequence
ggacaggcaaggccugcguu

SEQ ID NO: 5874 - RNA, 20 nt, Artificial Sequence
  Guide Sequence
ggcaaggccugcguuugggg

SEQ ID NO: 5875 - RNA, 20 nt, Artificial Sequence
  Guide Sequence
ggccuugccuguccggcgau

SEQ ID NO: 5876 - RNA, 20 nt, Artificial Sequence
  Guide Sequence
ucgccggacaggcaaggccu

SEQ ID NO: 5877 - RNA, 20 nt, Artificial Sequence
  Guide Sequence
ugccuguccggcgauucugu

SEQ ID NO: 5878 - RNA, 20 nt, Artificial Sequence
  Guide Sequence
uggacagaaucgccggacag

SEQ ID NO: 5879 - RNA, 20 nt, Artificial Sequence
  Guide Sequence
uugccuguccggcgauucug

SEQ ID NO: 5880 - RNA, 21 nt, Artificial Sequence
  Guide Sequence
aaacgcaggccuugccugucc

SEQ ID NO: 5881 - RNA, 21 nt, Artificial Sequence
  Guide Sequence
aacgcaggccuugccuguccg

SEQ ID NO: 5882 - RNA, 21 nt, Artificial Sequence
  Guide Sequence
aaucgccggacaggcaaggcc

SEQ ID NO: 5883 - RNA, 21 nt, Artificial Sequence
  Guide Sequence
acagaaucgccggacaggcaa

SEQ ID NO: 5884 - RNA, 21 nt, Artificial Sequence
  Guide Sequence
acaggcaaggccugcguuugg

SEQ ID NO: 5885 - RNA, 21 nt, Artificial Sequence
  Guide Sequence
accccaaacgcaggccuugcc

SEQ ID NO: 5886 - RNA, 21 nt, Artificial Sequence
  Guide Sequence
acgcaggccuugccuguccgg

SEQ ID NO: 5887 - RNA, 21 nt, Artificial Sequence
  Guide Sequence
agaaucgccggacaggcaagg

SEQ ID NO: 5888 - RNA, 21 nt, Artificial Sequence
  Guide Sequence
agccccaccccaaacgcaggc

SEQ ID NO: 5889 - RNA, 21 nt, Artificial Sequence
  Guide Sequence
aggcaaggccugcguuugggg

SEQ ID NO: 5890 - RNA, 21 nt, Artificial Sequence
  Guide Sequence
aggccuugccuguccggcgau

SEQ ID NO: 5891 - RNA, 21 nt, Artificial Sequence
  Guide Sequence
aucgccggacaggcaaggccu

SEQ ID NO: 5892 - RNA, 21 nt, Artificial Sequence
  Guide Sequence
caaacgcaggccuugccuguc

SEQ ID NO: 5893 - RNA, 21 nt, Artificial Sequence
  Guide Sequence
caccccaaacgcaggccuugc

SEQ ID NO: 5894 - RNA, 21 nt, Artificial Sequence
  Guide Sequence
cagaaucgccggacaggcaag

SEQ ID NO: 5895 - RNA, 21 nt, Artificial Sequence
  Guide Sequence
caggcaaggccugcguuuggg

SEQ ID NO: 5896 - RNA, 21 nt, Artificial Sequence
  Guide Sequence
caggccuugccuguccggcga

SEQ ID NO: 5897 - RNA, 21 nt, Artificial Sequence
  Guide Sequence
ccaaacgcaggccuugccugu

SEQ ID NO: 5898 - RNA, 21 nt, Artificial Sequence
  Guide Sequence
ccaccccaaacgcaggccuug

SEQ ID NO: 5899 - RNA, 21 nt, Artificial Sequence
  Guide Sequence
cccaaacgcaggccuugccug

SEQ ID NO: 5900 - RNA, 21 nt, Artificial Sequence
  Guide Sequence
ccccaaacgcaggccuugccu

SEQ ID NO: 5901 - RNA, 21 nt, Artificial Sequence
  Guide Sequence
ccccaccccaaacgcaggccu

SEQ ID NO: 5902 - RNA, 21 nt, Artificial Sequence
  Guide Sequence
ccggacaggcaaggccugcgu

SEQ ID NO: 5903 - RNA, 21 nt, Artificial Sequence
  Guide Sequence
ccuugccuguccggcgauucu

SEQ ID NO: 5904 - RNA, 21 nt, Artificial Sequence
  Guide Sequence
cgcaggccuugccuguccggc

SEQ ID NO: 5905 - RNA, 21 nt, Artificial Sequence
  Guide Sequence
cgccggacaggcaaggccugc

SEQ ID NO: 5906 - RNA, 21 nt, Artificial Sequence
  Guide Sequence
cggacaggcaaggccugcguu

SEQ ID NO: 5907 - RNA, 21 nt, Artificial Sequence
  Guide Sequence
cuggacagaaucgccggacag

SEQ ID NO: 5908 - RNA, 21 nt, Artificial Sequence
  Guide Sequence
cuugccuguccggcgauucug

SEQ ID NO: 5909 - RNA, 21 nt, Artificial Sequence
  Guide Sequence
gaaucgccggacaggcaaggc

SEQ ID NO: 5910 - RNA, 21 nt, Artificial Sequence
  Guide Sequence
gacagaaucgccggacaggca

SEQ ID NO: 5911 - RNA, 21 nt, Artificial Sequence
  Guide Sequence
gacaggcaaggccugcguuug

SEQ ID NO: 5912 - RNA, 21 nt, Artificial Sequence
  Guide Sequence
gcaaggccugcguuuggggug

SEQ ID NO: 5913 - RNA, 21 nt, Artificial Sequence
  Guide Sequence
gcaggccuugccuguccggcg

SEQ ID NO: 5914 - RNA, 21 nt, Artificial Sequence
  Guide Sequence
gccccaccccaaacgcaggcc

SEQ ID NO: 5915 - RNA, 21 nt, Artificial Sequence
  Guide Sequence
gccggacaggcaaggccugcg

SEQ ID NO: 5916 - RNA, 21 nt, Artificial Sequence
  Guide Sequence
gccuugccuguccggcgauuc

SEQ ID NO: 5917 - RNA, 21 nt, Artificial Sequence
  Guide Sequence
ggacagaaucgccggacaggc

SEQ ID NO: 5918 - RNA, 21 nt, Artificial Sequence
  Guide Sequence
ggacaggcaaggccugcguuu

SEQ ID NO: 5919 - RNA, 21 nt, Artificial Sequence
  Guide Sequence
ggcaaggccugcguuuggggu

SEQ ID NO: 5920 - RNA, 21 nt, Artificial Sequence
  Guide Sequence
ggccuugccuguccggcgauu

SEQ ID NO: 5921 - RNA, 21 nt, Artificial Sequence
  Guide Sequence
ucgccggacaggcaaggccug

SEQ ID NO: 5922 - RNA, 21 nt, Artificial Sequence
  Guide Sequence
ucuggacagaaucgccggaca

SEQ ID NO: 5923 - RNA, 21 nt, Artificial Sequence
  Guide Sequence
ugccuguccggcgauucuguc

SEQ ID NO: 5924 - RNA, 21 nt, Artificial Sequence
  Guide Sequence
uggacagaaucgccggacagg

SEQ ID NO: 5925 - RNA, 21 nt, Artificial Sequence
  Guide Sequence
uugccuguccggcgauucugu

SEQ ID NO: 5926 - RNA, 22 nt, Artificial Sequence
  Guide Sequence
aaacgcaggccuugccuguccg

SEQ ID NO: 5927 - RNA, 22 nt, Artificial Sequence
  Guide Sequence
aacgcaggccuugccuguccgg

SEQ ID NO: 5928 - RNA, 22 nt, Artificial Sequence
  Guide Sequence
aaucgccggacaggcaaggccu

SEQ ID NO: 5929 - RNA, 22 nt, Artificial Sequence
  Guide Sequence
acagaaucgccggacaggcaag

SEQ ID NO: 5930 - RNA, 22 nt, Artificial Sequence
  Guide Sequence
acaggcaaggccugcguuuggg

SEQ ID NO: 5931 - RNA, 22 nt, Artificial Sequence
  Guide Sequence
accccaaacgcaggccuugccu

SEQ ID NO: 5932 - RNA, 22 nt, Artificial Sequence
  Guide Sequence
acgcaggccuugccuguccggc

SEQ ID NO: 5933 - RNA, 22 nt, Artificial Sequence
  Guide Sequence
agaaucgccggacaggcaaggc

SEQ ID NO: 5934 - RNA, 22 nt, Artificial Sequence
  Guide Sequence
agccccaccccaaacgcaggcc

SEQ ID NO: 5935 - RNA, 22 nt, Artificial Sequence
  Guide Sequence
aggcaaggccugcguuuggggu

SEQ ID NO: 5936 - RNA, 22 nt, Artificial Sequence
  Guide Sequence
aggccuugccuguccggcgauu

SEQ ID NO: 5937 - RNA, 22 nt, Artificial Sequence
  Guide Sequence
aucgccggacaggcaaggccug

SEQ ID NO: 5938 - RNA, 22 nt, Artificial Sequence
  Guide Sequence
aucuggacagaaucgccggaca

SEQ ID NO: 5939 - RNA, 22 nt, Artificial Sequence
  Guide Sequence
caaacgcaggccuugccugucc

SEQ ID NO: 5940 - RNA, 22 nt, Artificial Sequence
  Guide Sequence
caccccaaacgcaggccuugcc

SEQ ID NO: 5941 - RNA, 22 nt, Artificial Sequence
  Guide Sequence
cagaaucgccggacaggcaagg

SEQ ID NO: 5942 - RNA, 22 nt, Artificial Sequence
  Guide Sequence
cagccccaccccaaacgcaggc

SEQ ID NO: 5943 - RNA, 22 nt, Artificial Sequence
  Guide Sequence
caggcaaggccugcguuugggg

SEQ ID NO: 5944 - RNA, 22 nt, Artificial Sequence
  Guide Sequence
caggccuugccuguccggcgau

SEQ ID NO: 5945 - RNA, 22 nt, Artificial Sequence
  Guide Sequence
ccaaacgcaggccuugccuguc

SEQ ID NO: 5946 - RNA, 22 nt, Artificial Sequence
  Guide Sequence
ccaccccaaacgcaggccuugc

SEQ ID NO: 5947 - RNA, 22 nt, Artificial Sequence
  Guide Sequence
cccaaacgcaggccuugccugu

SEQ ID NO: 5948 - RNA, 22 nt, Artificial Sequence
  Guide Sequence
cccaccccaaacgcaggccuug

SEQ ID NO: 5949 - RNA, 22 nt, Artificial Sequence
  Guide Sequence
ccccaaacgcaggccuugccug

SEQ ID NO: 5950 - RNA, 22 nt, Artificial Sequence
  Guide Sequence
ccggacaggcaaggccugcguu

SEQ ID NO: 5951 - RNA, 22 nt, Artificial Sequence
  Guide Sequence
ccuugccuguccggcgauucug

SEQ ID NO: 5952 - RNA, 22 nt, Artificial Sequence
  Guide Sequence
cgcaggccuugccuguccggcg

SEQ ID NO: 5953 - RNA, 22 nt, Artificial Sequence
  Guide Sequence
cgccggacaggcaaggccugcg

SEQ ID NO: 5954 - RNA, 22 nt, Artificial Sequence
  Guide Sequence
cggacaggcaaggccugcguuu

SEQ ID NO: 5955 - RNA, 22 nt, Artificial Sequence
  Guide Sequence
cuggacagaaucgccggacagg

SEQ ID NO: 5956 - RNA, 22 nt, Artificial Sequence
  Guide Sequence
cuugccuguccggcgauucugu

SEQ ID NO: 5957 - RNA, 22 nt, Artificial Sequence
  Guide Sequence
gaaucgccggacaggcaaggcc

SEQ ID NO: 5958 - RNA, 22 nt, Artificial Sequence
  Guide Sequence
gacagaaucgccggacaggcaa

SEQ ID NO: 5959 - RNA, 22 nt, Artificial Sequence
  Guide Sequence
gacaggcaaggccugcguuugg

SEQ ID NO: 5960 - RNA, 22 nt, Artificial Sequence
  Guide Sequence
gcaaggccugcguuuggggugg

SEQ ID NO: 5961 - RNA, 22 nt, Artificial Sequence
  Guide Sequence
gcaggccuugccuguccggcga

SEQ ID NO: 5962 - RNA, 22 nt, Artificial Sequence
  Guide Sequence
gccccaccccaaacgcaggccu

SEQ ID NO: 5963 - RNA, 22 nt, Artificial Sequence
  Guide Sequence
gccggacaggcaaggccugcgu

SEQ ID NO: 5964 - RNA, 22 nt, Artificial Sequence
  Guide Sequence
gccuugccuguccggcgauucu

SEQ ID NO: 5965 - RNA, 22 nt, Artificial Sequence
  Guide Sequence
ggacagaaucgccggacaggca

SEQ ID NO: 5966 - RNA, 22 nt, Artificial Sequence
  Guide Sequence
ggacaggcaaggccugcguuug

SEQ ID NO: 5967 - RNA, 22 nt, Artificial Sequence
  Guide Sequence
ggcaaggccugcguuuggggug

SEQ ID NO: 5968 - RNA, 22 nt, Artificial Sequence
  Guide Sequence
ggccuugccuguccggcgauuc

SEQ ID NO: 5969 - RNA, 22 nt, Artificial Sequence
  Guide Sequence
ucgccggacaggcaaggccugc

SEQ ID NO: 5970 - RNA, 22 nt, Artificial Sequence
  Guide Sequence
ucuggacagaaucgccggacag

SEQ ID NO: 5971 - RNA, 22 nt, Artificial Sequence
  Guide Sequence
ugccuguccggcgauucugucc

SEQ ID NO: 5972 - RNA, 22 nt, Artificial Sequence
  Guide Sequence
uggacagaaucgccggacaggc

SEQ ID NO: 5973 - RNA, 22 nt, Artificial Sequence
  Guide Sequence
uugccuguccggcgauucuguc

SEQ ID NO: 5974 - RNA, 20 nt, Artificial Sequence
  Guide Sequence
accgggcgcgagguggcagg

SEQ ID NO: 5975 - RNA, 20 nt, Artificial Sequence
  Guide Sequence
agcuggaccgggcgcgaggc

SEQ ID NO: 5976 - RNA, 20 nt, Artificial Sequence
  Guide Sequence
agcuggaccgggcgcgaggu

SEQ ID NO: 5977 - RNA, 20 nt, Artificial Sequence
  Guide Sequence
aggcuucggcguccggcccu

SEQ ID NO: 5978 - RNA, 20 nt, Artificial Sequence
  Guide Sequence
agguggcagggccggacgcc

SEQ ID NO: 5979 - RNA, 20 nt, Artificial Sequence
  Guide Sequence
caccucgcgcccgguccagc

SEQ ID NO: 5980 - RNA, 20 nt, Artificial Sequence
  Guide Sequence
ccaccucgcgcccgguccag

SEQ ID NO: 5981 - RNA, 20 nt, Artificial Sequence
  Guide Sequence
ccgagcuggaccgggcgcga

SEQ ID NO: 5982 - RNA, 20 nt, Artificial Sequence
  Guide Sequence
ccugccaccucgcgcccggu

SEQ ID NO: 5983 - RNA, 20 nt, Artificial Sequence
  Guide Sequence
cgagcuggaccgggcgcgag

SEQ ID NO: 5984 - RNA, 20 nt, Artificial Sequence
  Guide Sequence
cgagguggcagggccggacg

SEQ ID NO: 5985 - RNA, 20 nt, Artificial Sequence
  Guide Sequence
cgcgagguggcagggccgga

SEQ ID NO: 5986 - RNA, 20 nt, Artificial Sequence
  Guide Sequence
cguccggcccugccaccucg

SEQ ID NO: 5987 - RNA, 20 nt, Artificial Sequence
  Guide Sequence
cugccaccucgcgcccgguc

SEQ ID NO: 5988 - RNA, 20 nt, Artificial Sequence
  Guide Sequence
cuggaccgggcgcgaggugg

SEQ ID NO: 5989 - RNA, 20 nt, Artificial Sequence
  Guide Sequence
cuucggcguccggcccugcc

SEQ ID NO: 5990 - RNA, 20 nt, Artificial Sequence
  Guide Sequence
gaccgggcgcgagguggcag

SEQ ID NO: 5991 - RNA, 20 nt, Artificial Sequence
  Guide Sequence
gagcuggaccgggcgcgagg

SEQ ID NO: 5992 - RNA, 20 nt, Artificial Sequence
  Guide Sequence
gagguggcagggccggacgc

SEQ ID NO: 5993 - RNA, 20 nt, Artificial Sequence
  Guide Sequence
gccaccucgcgcccggucca

SEQ ID NO: 5994 - RNA, 20 nt, Artificial Sequence
  Guide Sequence
gcgagguggcagggccggac

SEQ ID NO: 5995 - RNA, 20 nt, Artificial Sequence
  Guide Sequence
gcguccggcccugccaccuc

SEQ ID NO: 5996 - RNA, 20 nt, Artificial Sequence
  Guide Sequence
gcuggaccgggcgcgaggug

SEQ ID NO: 5997 - RNA, 20 nt, Artificial Sequence
  Guide Sequence
gcuucggcguccggcccugc

SEQ ID NO: 5998 - RNA, 20 nt, Artificial Sequence
  Guide Sequence
ggaccgggcgcgagguggca

SEQ ID NO: 5999 - RNA, 20 nt, Artificial Sequence
  Guide Sequence
ggcguccggcccugccaccu

SEQ ID NO: 6000 - RNA, 20 nt, Artificial Sequence
  Guide Sequence
ggcuucggcguccggcccug

SEQ ID NO: 6001 - RNA, 20 nt, Artificial Sequence
  Guide Sequence
guccggcccugccaccucgc

SEQ ID NO: 6002 - RNA, 20 nt, Artificial Sequence
  Guide Sequence
guggcagggccggacgccga

SEQ ID NO: 6003 - RNA, 20 nt, Artificial Sequence
  Guide Sequence
uccgagcuggaccgggcgcg

SEQ ID NO: 6004 - RNA, 20 nt, Artificial Sequence
  Guide Sequence
uccggcccugccaccucgcg

SEQ ID NO: 6005 - RNA, 20 nt, Artificial Sequence
  Guide Sequence
ucggcguccggcccugccac

SEQ ID NO: 6006 - RNA, 20 nt, Artificial Sequence
  Guide Sequence
ugccaccucgcgcccggucc

SEQ ID NO: 6007 - RNA, 20 nt, Artificial Sequence
  Guide Sequence
uggaccgggcgcgagguggc

SEQ ID NO: 6008 - RNA, 20 nt, Artificial Sequence
  Guide Sequence
uucggcguccggcccugcca

SEQ ID NO: 6009 - RNA, 20 nt, Artificial Sequence
  Guide Sequence
uucggcguccggcccugccg

SEQ ID NO: 6010 - RNA, 21 nt, Artificial Sequence
  Guide Sequence
agcuggaccgggcgcgaggug

SEQ ID NO: 6011 - RNA, 21 nt, Artificial Sequence
  Guide Sequence
aggcuucggcguccggcccug

SEQ ID NO: 6012 - RNA, 21 nt, Artificial Sequence
  Guide Sequence
caccucgcgcccgguccagcu

SEQ ID NO: 6013 - RNA, 21 nt, Artificial Sequence
  Guide Sequence
cuucggcguccggcccugcca

SEQ ID NO: 6014 - RNA, 21 nt, Artificial Sequence
  Guide Sequence
gagcuggaccgggcgcgaggu

SEQ ID NO: 6015 - RNA, 21 nt, Artificial Sequence
  Guide Sequence
gaggcuucggcguccggcccu

SEQ ID NO: 6016 - RNA, 21 nt, Artificial Sequence
  Guide Sequence
guggcagggccggacgccgaa

SEQ ID NO: 6017 - RNA, 21 nt, Artificial Sequence
  Guide Sequence
uccgagcuggaccgggcgcga

SEQ ID NO: 6018 - RNA, 21 nt, Artificial Sequence
  Guide Sequence
ugccaccucgcgcccggucca

SEQ ID NO: 6019 - RNA, 21 nt, Artificial Sequence
  Guide Sequence
uggaccgggcgcgagguggca

SEQ ID NO: 6020 - RNA, 21 nt, Artificial Sequence
  Guide Sequence
uucggcguccggcccugccac

SEQ ID NO: 6021 - RNA, 22 nt, Artificial Sequence
  Guide Sequence
agcuggaccgggcgcgaggugg

SEQ ID NO: 6022 - RNA, 22 nt, Artificial Sequence
  Guide Sequence
aggcuucggcguccggcccugc

SEQ ID NO: 6023 - RNA, 22 nt, Artificial Sequence
  Guide Sequence
agguggcagggccggacgccga

SEQ ID NO: 6024 - RNA, 22 nt, Artificial Sequence
  Guide Sequence
caccucgcgcccgguccagcuc

SEQ ID NO: 6025 - RNA, 22 nt, Artificial Sequence
  Guide Sequence
ccaccucgcgcccgguccagcu

SEQ ID NO: 6026 - RNA, 22 nt, Artificial Sequence
  Guide Sequence
cgagcuggaccgggcgcgaggu

SEQ ID NO: 6027 - RNA, 22 nt, Artificial Sequence
  Guide Sequence
cuccgagcuggaccgggcgcga

SEQ ID NO: 6028 - RNA, 22 nt, Artificial Sequence
  Guide Sequence
cugccaccucgcgcccggucca

SEQ ID NO: 6029 - RNA, 22 nt, Artificial Sequence
  Guide Sequence
cuggaccgggcgcgagguggca

SEQ ID NO: 6030 - RNA, 22 nt, Artificial Sequence
  Guide Sequence
cuucggcguccggcccugccac

SEQ ID NO: 6031 - RNA, 22 nt, Artificial Sequence
  Guide Sequence
gagcuggaccgggcgcgaggug

SEQ ID NO: 6032 - RNA, 22 nt, Artificial Sequence
  Guide Sequence
gaggcuucggcguccggcccug

SEQ ID NO: 6033 - RNA, 22 nt, Artificial Sequence
  Guide Sequence
gcuucggcguccggcccugcca

SEQ ID NO: 6034 - RNA, 22 nt, Artificial Sequence
  Guide Sequence
gguggcagggccggacgccgaa

SEQ ID NO: 6035 - RNA, 22 nt, Artificial Sequence
  Guide Sequence
guggcagggccggacgccgaag

SEQ ID NO: 6036 - RNA, 22 nt, Artificial Sequence
  Guide Sequence
uccgagcuggaccgggcgcgag

SEQ ID NO: 6037 - RNA, 22 nt, Artificial Sequence
  Guide Sequence
ucggcguccggcccugccaccu

SEQ ID NO: 6038 - RNA, 22 nt, Artificial Sequence
  Guide Sequence
ugaggcuucggcguccggcccu

SEQ ID NO: 6039 - RNA, 22 nt, Artificial Sequence
  Guide Sequence
ugccaccucgcgcccgguccag

SEQ ID NO: 6040 - RNA, 22 nt, Artificial Sequence
  Guide Sequence
uggaccgggcgcgagguggcag

SEQ ID NO: 6041 - RNA, 22 nt, Artificial Sequence
  Guide Sequence
uucggcguccggcccugccacc

SEQ ID NO: 6042 - RNA, 20 nt, Artificial Sequence
  Guide Sequence
aagauggguaagcaggguag

SEQ ID NO: 6043 - RNA, 20 nt, Artificial Sequence
  Guide Sequence
aagcaggguagagggggcug

SEQ ID NO: 6044 - RNA, 20 nt, Artificial Sequence
  Guide Sequence
accaagauggguaagcaggg

SEQ ID NO: 6045 - RNA, 20 nt, Artificial Sequence
  Guide Sequence
acuccaucaaugcagccccc

SEQ ID NO: 6046 - RNA, 20 nt, Artificial Sequence
  Guide Sequence
agagggggcugcauugaugg

SEQ ID NO: 6047 - RNA, 20 nt, Artificial Sequence
  Guide Sequence
agauggguaagcaggguaga

SEQ ID NO: 6048 - RNA, 20 nt, Artificial Sequence
  Guide Sequence
agauggguaagcaggguagg

SEQ ID NO: 6049 - RNA, 20 nt, Artificial Sequence
  Guide Sequence
agcaggguagagggggcugc

SEQ ID NO: 6050 - RNA, 20 nt, Artificial Sequence
  Guide Sequence
agcccccucuacccugcuua

SEQ ID NO: 6051 - RNA, 20 nt, Artificial Sequence
  Guide Sequence
aggguagagggggcugcauu

SEQ ID NO: 6052 - RNA, 20 nt, Artificial Sequence
  Guide Sequence
aucaaugcagcccccucuac

SEQ ID NO: 6053 - RNA, 20 nt, Artificial Sequence
  Guide Sequence
auggguaagcaggguagagg

SEQ ID NO: 6054 - RNA, 20 nt, Artificial Sequence
  Guide Sequence
auggguaagcaggguagggg

SEQ ID NO: 6055 - RNA, 20 nt, Artificial Sequence
  Guide Sequence
caagauggguaagcagggua

SEQ ID NO: 6056 - RNA, 20 nt, Artificial Sequence
  Guide Sequence
caaugcagcccccucuaccc

SEQ ID NO: 6057 - RNA, 20 nt, Artificial Sequence
  Guide Sequence
cagcccccucuacccugcuu

SEQ ID NO: 6058 - RNA, 20 nt, Artificial Sequence
  Guide Sequence
caggguagagggggcugcau

SEQ ID NO: 6059 - RNA, 20 nt, Artificial Sequence
  Guide Sequence
caucaaugcagcccccucua

SEQ ID NO: 6060 - RNA, 20 nt, Artificial Sequence
  Guide Sequence
ccaagauggguaagcagggu

SEQ ID NO: 6061 - RNA, 20 nt, Artificial Sequence
  Guide Sequence
ccaucaaugcagcccccucu

SEQ ID NO: 6062 - RNA, 20 nt, Artificial Sequence
  Guide Sequence
ccccccuacccugcuuaccc

SEQ ID NO: 6063 - RNA, 20 nt, Artificial Sequence
  Guide Sequence
cccccuacccugcuuaccca

SEQ ID NO: 6064 - RNA, 20 nt, Artificial Sequence
  Guide Sequence
cccccucuacccugcuuacc

SEQ ID NO: 6065 - RNA, 20 nt, Artificial Sequence
  Guide Sequence
ccccuacccugcuuacccau

SEQ ID NO: 6066 - RNA, 20 nt, Artificial Sequence
  Guide Sequence
ccccucuacccugcuuaccc

SEQ ID NO: 6067 - RNA, 20 nt, Artificial Sequence
  Guide Sequence
cccuacccugcuuacccauc

SEQ ID NO: 6068 - RNA, 20 nt, Artificial Sequence
  Guide Sequence
cccucuacccugcuuaccca

SEQ ID NO: 6069 - RNA, 20 nt, Artificial Sequence
  Guide Sequence
ccucuacccugcuuacccau

SEQ ID NO: 6070 - RNA, 20 nt, Artificial Sequence
  Guide Sequence
cuacuccaucaaugcagccc

SEQ ID NO: 6071 - RNA, 20 nt, Artificial Sequence
  Guide Sequence
cuccaucaaugcagcccccc

SEQ ID NO: 6072 - RNA, 20 nt, Artificial Sequence
  Guide Sequence
cuccaucaaugcagcccccu

SEQ ID NO: 6073 - RNA, 20 nt, Artificial Sequence
  Guide Sequence
cucuacccugcuuacccauc

SEQ ID NO: 6074 - RNA, 20 nt, Artificial Sequence
  Guide Sequence
gagggggcugcauugaugga

SEQ ID NO: 6075 - RNA, 20 nt, Artificial Sequence
  Guide Sequence
gauggguaagcaggguagag

SEQ ID NO: 6076 - RNA, 20 nt, Artificial Sequence
  Guide Sequence
gauggguaagcaggguaggg

SEQ ID NO: 6077 - RNA, 20 nt, Artificial Sequence
  Guide Sequence
gcaggguagagggggcugca

SEQ ID NO: 6078 - RNA, 20 nt, Artificial Sequence
  Guide Sequence
gcccccucuacccugcuuac

SEQ ID NO: 6079 - RNA, 20 nt, Artificial Sequence
  Guide Sequence
gcuacuccaucaaugcagcc

SEQ ID NO: 6080 - RNA, 20 nt, Artificial Sequence
  Guide Sequence
ggguaagcaggguagagggg

SEQ ID NO: 6081 - RNA, 20 nt, Artificial Sequence
  Guide Sequence
ggguaagcaggguagggggg

SEQ ID NO: 6082 - RNA, 20 nt, Artificial Sequence
  Guide Sequence
ggguagagggggcugcauug

SEQ ID NO: 6083 - RNA, 20 nt, Artificial Sequence
  Guide Sequence
gguaagcaggguagaggggg

SEQ ID NO: 6084 - RNA, 20 nt, Artificial Sequence
  Guide Sequence
gguagagggggcugcauuga

SEQ ID NO: 6085 - RNA, 20 nt, Artificial Sequence
  Guide Sequence
guaagcaggguagagggggc

SEQ ID NO: 6086 - RNA, 20 nt, Artificial Sequence
  Guide Sequence
guagagggggcugcauugau

SEQ ID NO: 6087 - RNA, 20 nt, Artificial Sequence
  Guide Sequence
uaagcaggguagagggggcu

SEQ ID NO: 6088 - RNA, 20 nt, Artificial Sequence
  Guide Sequence
uacuccaucaaugcagcccc

SEQ ID NO: 6089 - RNA, 20 nt, Artificial Sequence
  Guide Sequence
uagagggggcugcauugaug

SEQ ID NO: 6090 - RNA, 20 nt, Artificial Sequence
  Guide Sequence
ucaaugcagcccccucuacc

SEQ ID NO: 6091 - RNA, 20 nt, Artificial Sequence
  Guide Sequence
uccaucaaugcagcccccuc

SEQ ID NO: 6092 - RNA, 20 nt, Artificial Sequence
  Guide Sequence
uggguaagcaggguagaggg

SEQ ID NO: 6093 - RNA, 20 nt, Artificial Sequence
  Guide Sequence
uggguaagcaggguaggggg

SEQ ID NO: 6094 - RNA, 21 nt, Artificial Sequence
  Guide Sequence
aagauggguaagcaggguaga

SEQ ID NO: 6095 - RNA, 21 nt, Artificial Sequence
  Guide Sequence
aagauggguaagcaggguagg

SEQ ID NO: 6096 - RNA, 21 nt, Artificial Sequence
  Guide Sequence
aagcaggguagagggggcugc

SEQ ID NO: 6097 - RNA, 21 nt, Artificial Sequence
  Guide Sequence
accaagauggguaagcagggu

SEQ ID NO: 6098 - RNA, 21 nt, Artificial Sequence
  Guide Sequence
acuccaucaaugcagcccccc

SEQ ID NO: 6099 - RNA, 21 nt, Artificial Sequence
  Guide Sequence
acuccaucaaugcagcccccu

SEQ ID NO: 6100 - RNA, 21 nt, Artificial Sequence
  Guide Sequence
agagggggcugcauugaugga

SEQ ID NO: 6101 - RNA, 21 nt, Artificial Sequence
  Guide Sequence
agauggguaagcaggguagag

SEQ ID NO: 6102 - RNA, 21 nt, Artificial Sequence
  Guide Sequence
agauggguaagcaggguaggg

SEQ ID NO: 6103 - RNA, 21 nt, Artificial Sequence
  Guide Sequence
agcaggguagagggggcugca

SEQ ID NO: 6104 - RNA, 21 nt, Artificial Sequence
  Guide Sequence
agcccccucuacccugcuuac

SEQ ID NO: 6105 - RNA, 21 nt, Artificial Sequence
  Guide Sequence
aggguagagggggcugcauug

SEQ ID NO: 6106 - RNA, 21 nt, Artificial Sequence
  Guide Sequence
aucaaugcagcccccucuacc

SEQ ID NO: 6107 - RNA, 21 nt, Artificial Sequence
  Guide Sequence
auggguaagcaggguagaggg

SEQ ID NO: 6108 - RNA, 21 nt, Artificial Sequence
  Guide Sequence
auggguaagcaggguaggggg

SEQ ID NO: 6109 - RNA, 21 nt, Artificial Sequence
  Guide Sequence
caagauggguaagcaggguag

SEQ ID NO: 6110 - RNA, 21 nt, Artificial Sequence
  Guide Sequence
cagcccccucuacccugcuua

SEQ ID NO: 6111 - RNA, 21 nt, Artificial Sequence
  Guide Sequence
caggguagagggggcugcauu

SEQ ID NO: 6112 - RNA, 21 nt, Artificial Sequence
  Guide Sequence
caucaaugcagcccccucuac

SEQ ID NO: 6113 - RNA, 21 nt, Artificial Sequence
  Guide Sequence
ccaagauggguaagcagggua

SEQ ID NO: 6114 - RNA, 21 nt, Artificial Sequence
  Guide Sequence
ccaucaaugcagcccccucua

SEQ ID NO: 6115 - RNA, 21 nt, Artificial Sequence
  Guide Sequence
ccccccuacccugcuuaccca

SEQ ID NO: 6116 - RNA, 21 nt, Artificial Sequence
  Guide Sequence
cccccuacccugcuuacccau

SEQ ID NO: 6117 - RNA, 21 nt, Artificial Sequence
  Guide Sequence
cccccucuacccugcuuaccc

SEQ ID NO: 6118 - RNA, 21 nt, Artificial Sequence
  Guide Sequence
ccccuacccugcuuacccauc

SEQ ID NO: 6119 - RNA, 21 nt, Artificial Sequence
  Guide Sequence
ccccucuacccugcuuaccca

SEQ ID NO: 6120 - RNA, 21 nt, Artificial Sequence
  Guide Sequence
cccuacccugcuuacccaucu

SEQ ID NO: 6121 - RNA, 21 nt, Artificial Sequence
  Guide Sequence
cccucuacccugcuuacccau

SEQ ID NO: 6122 - RNA, 21 nt, Artificial Sequence
  Guide Sequence
ccucuacccugcuuacccauc

SEQ ID NO: 6123 - RNA, 21 nt, Artificial Sequence
  Guide Sequence
cuacuccaucaaugcagcccc

SEQ ID NO: 6124 - RNA, 21 nt, Artificial Sequence
  Guide Sequence
cuccaucaaugcagcccccuc

SEQ ID NO: 6125 - RNA, 21 nt, Artificial Sequence
  Guide Sequence
cucuacccugcuuacccaucu

SEQ ID NO: 6126 - RNA, 21 nt, Artificial Sequence
  Guide Sequence
gaccaagauggguaagcaggg

SEQ ID NO: 6127 - RNA, 21 nt, Artificial Sequence
  Guide Sequence
gagggggcugcauugauggag

SEQ ID NO: 6128 - RNA, 21 nt, Artificial Sequence
  Guide Sequence
gauggguaagcaggguagagg

SEQ ID NO: 6129 - RNA, 21 nt, Artificial Sequence
  Guide Sequence
gauggguaagcaggguagggg

SEQ ID NO: 6130 - RNA, 21 nt, Artificial Sequence
  Guide Sequence
gcagcccccucuacccugcuu

SEQ ID NO: 6131 - RNA, 21 nt, Artificial Sequence
  Guide Sequence
gcaggguagagggggcugcau

SEQ ID NO: 6132 - RNA, 21 nt, Artificial Sequence
  Guide Sequence
gcccccucuacccugcuuacc

SEQ ID NO: 6133 - RNA, 21 nt, Artificial Sequence
  Guide Sequence
gcuacuccaucaaugcagccc

SEQ ID NO: 6134 - RNA, 21 nt, Artificial Sequence
  Guide Sequence
ggcuacuccaucaaugcagcc

SEQ ID NO: 6135 - RNA, 21 nt, Artificial Sequence
  Guide Sequence
ggguaagcaggguagaggggg

SEQ ID NO: 6136 - RNA, 21 nt, Artificial Sequence
  Guide Sequence
ggguagagggggcugcauuga

SEQ ID NO: 6137 - RNA, 21 nt, Artificial Sequence
  Guide Sequence
gguaagcaggguagagggggc

SEQ ID NO: 6138 - RNA, 21 nt, Artificial Sequence
  Guide Sequence
gguagagggggcugcauugau

SEQ ID NO: 6139 - RNA, 21 nt, Artificial Sequence
  Guide Sequence
guaagcaggguagagggggcu

SEQ ID NO: 6140 - RNA, 21 nt, Artificial Sequence
  Guide Sequence
guagagggggcugcauugaug

SEQ ID NO: 6141 - RNA, 21 nt, Artificial Sequence
  Guide Sequence
uaagcaggguagagggggcug

SEQ ID NO: 6142 - RNA, 21 nt, Artificial Sequence
  Guide Sequence
uacuccaucaaugcagccccc

SEQ ID NO: 6143 - RNA, 21 nt, Artificial Sequence
  Guide Sequence
uagagggggcugcauugaugg

SEQ ID NO: 6144 - RNA, 21 nt, Artificial Sequence
  Guide Sequence
ucaaugcagcccccucuaccc

SEQ ID NO: 6145 - RNA, 21 nt, Artificial Sequence
  Guide Sequence
uccaucaaugcagcccccucu

SEQ ID NO: 6146 - RNA, 21 nt, Artificial Sequence
  Guide Sequence
uggguaagcaggguagagggg

SEQ ID NO: 6147 - RNA, 21 nt, Artificial Sequence
  Guide Sequence
uggguaagcaggguagggggg

SEQ ID NO: 6148 - RNA, 22 nt, Artificial Sequence
  Guide Sequence
aagauggguaagcaggguagag

SEQ ID NO: 6149 - RNA, 22 nt, Artificial Sequence
  Guide Sequence
aagauggguaagcaggguaggg

SEQ ID NO: 6150 - RNA, 22 nt, Artificial Sequence
  Guide Sequence
aagcaggguagagggggcugca

SEQ ID NO: 6151 - RNA, 22 nt, Artificial Sequence
  Guide Sequence
accaagauggguaagcagggua

SEQ ID NO: 6152 - RNA, 22 nt, Artificial Sequence
  Guide Sequence
acuccaucaaugcagcccccuc

SEQ ID NO: 6153 - RNA, 22 nt, Artificial Sequence
  Guide Sequence
agagggggcugcauugauggag

SEQ ID NO: 6154 - RNA, 22 nt, Artificial Sequence
  Guide Sequence
agauggguaagcaggguagagg

SEQ ID NO: 6155 - RNA, 22 nt, Artificial Sequence
  Guide Sequence
agauggguaagcaggguagggg

SEQ ID NO: 6156 - RNA, 22 nt, Artificial Sequence
  Guide Sequence
agcaggguagagggggcugcau

SEQ ID NO: 6157 - RNA, 22 nt, Artificial Sequence
  Guide Sequence
agcccccucuacccugcuuacc

SEQ ID NO: 6158 - RNA, 22 nt, Artificial Sequence
  Guide Sequence
aggcuacuccaucaaugcagcc

SEQ ID NO: 6159 - RNA, 22 nt, Artificial Sequence
  Guide Sequence
aggguagagggggcugcauuga

SEQ ID NO: 6160 - RNA, 22 nt, Artificial Sequence
  Guide Sequence
aucaaugcagcccccucuaccc

SEQ ID NO: 6161 - RNA, 22 nt, Artificial Sequence
  Guide Sequence
auggguaagcaggguagagggg

SEQ ID NO: 6162 - RNA, 22 nt, Artificial Sequence
  Guide Sequence
auggguaagcaggguagggggg

SEQ ID NO: 6163 - RNA, 22 nt, Artificial Sequence
  Guide Sequence
caagauggguaagcaggguaga

SEQ ID NO: 6164 - RNA, 22 nt, Artificial Sequence
  Guide Sequence
caagauggguaagcaggguagg

SEQ ID NO: 6165 - RNA, 22 nt, Artificial Sequence
  Guide Sequence
cagcccccucuacccugcuuac

SEQ ID NO: 6166 - RNA, 22 nt, Artificial Sequence
  Guide Sequence
caggguagagggggcugcauug

SEQ ID NO: 6167 - RNA, 22 nt, Artificial Sequence
  Guide Sequence
caucaaugcagcccccucuacc

SEQ ID NO: 6168 - RNA, 22 nt, Artificial Sequence
  Guide Sequence
ccaagauggguaagcaggguag

SEQ ID NO: 6169 - RNA, 22 nt, Artificial Sequence
  Guide Sequence
ccaucaaugcagcccccucuac

SEQ ID NO: 6170 - RNA, 22 nt, Artificial Sequence
  Guide Sequence
ccccccuacccugcuuacccau

SEQ ID NO: 6171 - RNA, 22 nt, Artificial Sequence
  Guide Sequence
cccccuacccugcuuacccauc

SEQ ID NO: 6172 - RNA, 22 nt, Artificial Sequence
  Guide Sequence
cccccucuacccugcuuaccca

SEQ ID NO: 6173 - RNA, 22 nt, Artificial Sequence
  Guide Sequence
ccccuacccugcuuacccaucu

SEQ ID NO: 6174 - RNA, 22 nt, Artificial Sequence
  Guide Sequence
ccccucuacccugcuuacccau

SEQ ID NO: 6175 - RNA, 22 nt, Artificial Sequence
  Guide Sequence
cccuacccugcuuacccaucuu

SEQ ID NO: 6176 - RNA, 22 nt, Artificial Sequence
  Guide Sequence
cccucuacccugcuuacccauc

SEQ ID NO: 6177 - RNA, 22 nt, Artificial Sequence
  Guide Sequence
ccucuacccugcuuacccaucu

SEQ ID NO: 6178 - RNA, 22 nt, Artificial Sequence
  Guide Sequence
cuacuccaucaaugcagccccc

SEQ ID NO: 6179 - RNA, 22 nt, Artificial Sequence
  Guide Sequence
cuccaucaaugcagcccccucu

SEQ ID NO: 6180 - RNA, 22 nt, Artificial Sequence
  Guide Sequence
cucuacccugcuuacccaucuu

SEQ ID NO: 6181 - RNA, 22 nt, Artificial Sequence
  Guide Sequence
gaccaagauggguaagcagggu

SEQ ID NO: 6182 - RNA, 22 nt, Artificial Sequence
  Guide Sequence
gagggggcugcauugauggagu

SEQ ID NO: 6183 - RNA, 22 nt, Artificial Sequence
  Guide Sequence
gauggguaagcaggguagaggg

SEQ ID NO: 6184 - RNA, 22 nt, Artificial Sequence
  Guide Sequence
gauggguaagcaggguaggggg

SEQ ID NO: 6185 - RNA, 22 nt, Artificial Sequence
  Guide Sequence
gcagcccccucuacccugcuua

SEQ ID NO: 6186 - RNA, 22 nt, Artificial Sequence
  Guide Sequence
gcaggguagagggggcugcauu

SEQ ID NO: 6187 - RNA, 22 nt, Artificial Sequence
  Guide Sequence
gcccccucuacccugcuuaccc

SEQ ID NO: 6188 - RNA, 22 nt, Artificial Sequence
  Guide Sequence
gcuacuccaucaaugcagcccc

SEQ ID NO: 6189 - RNA, 22 nt, Artificial Sequence
  Guide Sequence
ggaccaagauggguaagcaggg

SEQ ID NO: 6190 - RNA, 22 nt, Artificial Sequence
  Guide Sequence
ggcuacuccaucaaugcagccc

SEQ ID NO: 6191 - RNA, 22 nt, Artificial Sequence
  Guide Sequence
ggguaagcaggguagagggggc

SEQ ID NO: 6192 - RNA, 22 nt, Artificial Sequence
  Guide Sequence
ggguagagggggcugcauugau

SEQ ID NO: 6193 - RNA, 22 nt, Artificial Sequence
  Guide Sequence
gguaagcaggguagagggggcu

SEQ ID NO: 6194 - RNA, 22 nt, Artificial Sequence
  Guide Sequence
gguagagggggcugcauugaug

SEQ ID NO: 6195 - RNA, 22 nt, Artificial Sequence
  Guide Sequence
guaagcaggguagagggggcug

SEQ ID NO: 6196 - RNA, 22 nt, Artificial Sequence
  Guide Sequence
guagagggggcugcauugaugg

SEQ ID NO: 6197 - RNA, 22 nt, Artificial Sequence
  Guide Sequence
uaagcaggguagagggggcugc

SEQ ID NO: 6198 - RNA, 22 nt, Artificial Sequence
  Guide Sequence
uacuccaucaaugcagcccccc

SEQ ID NO: 6199 - RNA, 22 nt, Artificial Sequence
  Guide Sequence
uacuccaucaaugcagcccccu

SEQ ID NO: 6200 - RNA, 22 nt, Artificial Sequence
  Guide Sequence
uagagggggcugcauugaugga

SEQ ID NO: 6201 - RNA, 22 nt, Artificial Sequence
  Guide Sequence
uccaucaaugcagcccccucua

SEQ ID NO: 6202 - RNA, 22 nt, Artificial Sequence
  Guide Sequence
ugcagcccccucuacccugcuu

SEQ ID NO: 6203 - RNA, 22 nt, Artificial Sequence
  Guide Sequence
uggguaagcaggguagaggggg

SEQ ID NO: 6204 - RNA, 20 nt, Artificial Sequence
  Guide Sequence
aaagcccauacuucgucagg

SEQ ID NO: 6205 - RNA, 20 nt, Artificial Sequence
  Guide Sequence
aaagcccauacuuugucagg

SEQ ID NO: 6206 - RNA, 20 nt, Artificial Sequence
  Guide Sequence
aaauaagucuaccugacaaa

SEQ ID NO: 6207 - RNA, 20 nt, Artificial Sequence
  Guide Sequence
aaauaagucuaccugacgaa

SEQ ID NO: 6208 - RNA, 20 nt, Artificial Sequence
  Guide Sequence
aagcauuuccaaagcccaua

SEQ ID NO: 6209 - RNA, 20 nt, Artificial Sequence
  Guide Sequence
aagcccauacuucgucaggu

SEQ ID NO: 6210 - RNA, 20 nt, Artificial Sequence
  Guide Sequence
aagcccauacuuugucaggu

SEQ ID NO: 6211 - RNA, 20 nt, Artificial Sequence
  Guide Sequence
aaggaaauaagucuaccuga

SEQ ID NO: 6212 - RNA, 20 nt, Artificial Sequence
  Guide Sequence
aagucuaccugacaaaguau

SEQ ID NO: 6213 - RNA, 20 nt, Artificial Sequence
  Guide Sequence
aagucuaccugacgaaguau

SEQ ID NO: 6214 - RNA, 20 nt, Artificial Sequence
  Guide Sequence
aauaagucuaccugacaaag

SEQ ID NO: 6215 - RNA, 20 nt, Artificial Sequence
  Guide Sequence
aauaagucuaccugacgaag

SEQ ID NO: 6216 - RNA, 20 nt, Artificial Sequence
  Guide Sequence
acaaaguaugggcuuuggaa

SEQ ID NO: 6217 - RNA, 20 nt, Artificial Sequence
  Guide Sequence
accugacaaaguaugggcuu

SEQ ID NO: 6218 - RNA, 20 nt, Artificial Sequence
  Guide Sequence
accugacgaaguaugggcuu

SEQ ID NO: 6219 - RNA, 20 nt, Artificial Sequence
  Guide Sequence
acgaaguaugggcuuuggaa

SEQ ID NO: 6220 - RNA, 20 nt, Artificial Sequence
  Guide Sequence
acuucgucagguagacuuau

SEQ ID NO: 6221 - RNA, 20 nt, Artificial Sequence
  Guide Sequence
acuuugucagguagacuuau

SEQ ID NO: 6222 - RNA, 20 nt, Artificial Sequence
  Guide Sequence
agaaggaaauaagucuaccu

SEQ ID NO: 6223 - RNA, 20 nt, Artificial Sequence
  Guide Sequence
agcauuuccaaagcccauac

SEQ ID NO: 6224 - RNA, 20 nt, Artificial Sequence
  Guide Sequence
agcccauacuucgucaggua

SEQ ID NO: 6225 - RNA, 20 nt, Artificial Sequence
  Guide Sequence
agcccauacuuugucaggua

SEQ ID NO: 6226 - RNA, 20 nt, Artificial Sequence
  Guide Sequence
aggaaauaagucuaccugac

SEQ ID NO: 6227 - RNA, 20 nt, Artificial Sequence
  Guide Sequence
agucuaccugacaaaguaug

SEQ ID NO: 6228 - RNA, 20 nt, Artificial Sequence
  Guide Sequence
agucuaccugacgaaguaug

SEQ ID NO: 6229 - RNA, 20 nt, Artificial Sequence
  Guide Sequence
auaagucuaccugacaaagu

SEQ ID NO: 6230 - RNA, 20 nt, Artificial Sequence
  Guide Sequence
auaagucuaccugacgaagu

SEQ ID NO: 6231 - RNA, 20 nt, Artificial Sequence
  Guide Sequence
auacuucgucagguagacuu

SEQ ID NO: 6232 - RNA, 20 nt, Artificial Sequence
  Guide Sequence
auacuuugucagguagacuu

SEQ ID NO: 6233 - RNA, 20 nt, Artificial Sequence
  Guide Sequence
auuuccaaagcccauacuuc

SEQ ID NO: 6234 - RNA, 20 nt, Artificial Sequence
  Guide Sequence
auuuccaaagcccauacuuu

SEQ ID NO: 6235 - RNA, 20 nt, Artificial Sequence
  Guide Sequence
caaagcccauacuucgucag

SEQ ID NO: 6236 - RNA, 20 nt, Artificial Sequence
  Guide Sequence
caaagcccauacuuugucag

SEQ ID NO: 6237 - RNA, 20 nt, Artificial Sequence
  Guide Sequence
caaaguaugggcuuuggaaa

SEQ ID NO: 6238 - RNA, 20 nt, Artificial Sequence
  Guide Sequence
cauacuucgucagguagacu

SEQ ID NO: 6239 - RNA, 20 nt, Artificial Sequence
  Guide Sequence
cauacuuugucagguagacu

SEQ ID NO: 6240 - RNA, 20 nt, Artificial Sequence
  Guide Sequence
cauuuccaaagcccauacuu

SEQ ID NO: 6241 - RNA, 20 nt, Artificial Sequence
  Guide Sequence
ccaaagcccauacuucguca

SEQ ID NO: 6242 - RNA, 20 nt, Artificial Sequence
  Guide Sequence
ccaaagcccauacuuuguca

SEQ ID NO: 6243 - RNA, 20 nt, Artificial Sequence
  Guide Sequence
ccauacuucgucagguagac

SEQ ID NO: 6244 - RNA, 20 nt, Artificial Sequence
  Guide Sequence
ccauacuuugucagguagac

SEQ ID NO: 6245 - RNA, 20 nt, Artificial Sequence
  Guide Sequence
cccauacuucgucagguaga

SEQ ID NO: 6246 - RNA, 20 nt, Artificial Sequence
  Guide Sequence
cccauacuuugucagguaga

SEQ ID NO: 6247 - RNA, 20 nt, Artificial Sequence
  Guide Sequence
ccugacaaaguaugggcuuu

SEQ ID NO: 6248 - RNA, 20 nt, Artificial Sequence
  Guide Sequence
ccugacgaaguaugggcuuu

SEQ ID NO: 6249 - RNA, 20 nt, Artificial Sequence
  Guide Sequence
cgaaguaugggcuuuggaaa

SEQ ID NO: 6250 - RNA, 20 nt, Artificial Sequence
  Guide Sequence
cuaccugacaaaguaugggc

SEQ ID NO: 6251 - RNA, 20 nt, Artificial Sequence
  Guide Sequence
cuaccugacgaaguaugggc

SEQ ID NO: 6252 - RNA, 20 nt, Artificial Sequence
  Guide Sequence
cugacaaaguaugggcuuug

SEQ ID NO: 6253 - RNA, 20 nt, Artificial Sequence
  Guide Sequence
cugacgaaguaugggcuuug

SEQ ID NO: 6254 - RNA, 20 nt, Artificial Sequence
  Guide Sequence
cuucgucagguagacuuauu

SEQ ID NO: 6255 - RNA, 20 nt, Artificial Sequence
  Guide Sequence
cuuugucagguagacuuauu

SEQ ID NO: 6256 - RNA, 20 nt, Artificial Sequence
  Guide Sequence
gaaauaagucuaccugacaa

SEQ ID NO: 6257 - RNA, 20 nt, Artificial Sequence
  Guide Sequence
gaaauaagucuaccugacga

SEQ ID NO: 6258 - RNA, 20 nt, Artificial Sequence
  Guide Sequence
gaaggaaauaagucuaccug

SEQ ID NO: 6259 - RNA, 20 nt, Artificial Sequence
  Guide Sequence
gacaaaguaugggcuuugga

SEQ ID NO: 6260 - RNA, 20 nt, Artificial Sequence
  Guide Sequence
gacgaaguaugggcuuugga

SEQ ID NO: 6261 - RNA, 20 nt, Artificial Sequence
  Guide Sequence
gcauuuccaaagcccauacu

SEQ ID NO: 6262 - RNA, 20 nt, Artificial Sequence
  Guide Sequence
gcccauacuucgucagguag

SEQ ID NO: 6263 - RNA, 20 nt, Artificial Sequence
  Guide Sequence
gcccauacuuugucagguag

SEQ ID NO: 6264 - RNA, 20 nt, Artificial Sequence
  Guide Sequence
ggaaauaagucuaccugaca

SEQ ID NO: 6265 - RNA, 20 nt, Artificial Sequence
  Guide Sequence
ggaaauaagucuaccugacg

SEQ ID NO: 6266 - RNA, 20 nt, Artificial Sequence
  Guide Sequence
gucuaccugacaaaguaugg

SEQ ID NO: 6267 - RNA, 20 nt, Artificial Sequence
  Guide Sequence
gucuaccugacgaaguaugg

SEQ ID NO: 6268 - RNA, 20 nt, Artificial Sequence
  Guide Sequence
uaagucuaccugacaaagua

SEQ ID NO: 6269 - RNA, 20 nt, Artificial Sequence
  Guide Sequence
uaagucuaccugacgaagua

SEQ ID NO: 6270 - RNA, 20 nt, Artificial Sequence
  Guide Sequence
uaccugacaaaguaugggcu

SEQ ID NO: 6271 - RNA, 20 nt, Artificial Sequence
  Guide Sequence
uaccugacgaaguaugggcu

SEQ ID NO: 6272 - RNA, 20 nt, Artificial Sequence
  Guide Sequence
uacuucgucagguagacuua

SEQ ID NO: 6273 - RNA, 20 nt, Artificial Sequence
  Guide Sequence
uacuuugucagguagacuua

SEQ ID NO: 6274 - RNA, 20 nt, Artificial Sequence
  Guide Sequence
uccaaagcccauacuucguc

SEQ ID NO: 6275 - RNA, 20 nt, Artificial Sequence
  Guide Sequence
uccaaagcccauacuuuguc

SEQ ID NO: 6276 - RNA, 20 nt, Artificial Sequence
  Guide Sequence
ucgucagguagacuuauuuc

SEQ ID NO: 6277 - RNA, 20 nt, Artificial Sequence
  Guide Sequence
ucuaccugacaaaguauggg

SEQ ID NO: 6278 - RNA, 20 nt, Artificial Sequence
  Guide Sequence
ucuaccugacgaaguauggg

SEQ ID NO: 6279 - RNA, 20 nt, Artificial Sequence
  Guide Sequence
ugacaaaguaugggcuuugg

SEQ ID NO: 6280 - RNA, 20 nt, Artificial Sequence
  Guide Sequence
ugacgaaguaugggcuuugg

SEQ ID NO: 6281 - RNA, 20 nt, Artificial Sequence
  Guide Sequence
uuccaaagcccauacuucgu

SEQ ID NO: 6282 - RNA, 20 nt, Artificial Sequence
  Guide Sequence
uuccaaagcccauacuuugu

SEQ ID NO: 6283 - RNA, 20 nt, Artificial Sequence
  Guide Sequence
uucgucagguagacuuauuu

SEQ ID NO: 6284 - RNA, 20 nt, Artificial Sequence
  Guide Sequence
uugucagguagacuuauuuc

SEQ ID NO: 6285 - RNA, 20 nt, Artificial Sequence
  Guide Sequence
uuuccaaagcccauacuucg

SEQ ID NO: 6286 - RNA, 20 nt, Artificial Sequence
  Guide Sequence
uuuccaaagcccauacuuug

SEQ ID NO: 6287 - RNA, 20 nt, Artificial Sequence
  Guide Sequence
uuugucagguagacuuauuu

SEQ ID NO: 6288 - RNA, 21 nt, Artificial Sequence
  Guide Sequence
aaagcccauacuucgucaggu

SEQ ID NO: 6289 - RNA, 21 nt, Artificial Sequence
  Guide Sequence
aaagcccauacuuugucaggu

SEQ ID NO: 6290 - RNA, 21 nt, Artificial Sequence
  Guide Sequence
aaauaagucuaccugacaaag

SEQ ID NO: 6291 - RNA, 21 nt, Artificial Sequence
  Guide Sequence
aaauaagucuaccugacgaag

SEQ ID NO: 6292 - RNA, 21 nt, Artificial Sequence
  Guide Sequence
aagcauuuccaaagcccauac

SEQ ID NO: 6293 - RNA, 21 nt, Artificial Sequence
  Guide Sequence
aagcccauacuucgucaggua

SEQ ID NO: 6294 - RNA, 21 nt, Artificial Sequence
  Guide Sequence
aagcccauacuuugucaggua

SEQ ID NO: 6295 - RNA, 21 nt, Artificial Sequence
  Guide Sequence
aaggaaauaagucuaccugac

SEQ ID NO: 6296 - RNA, 21 nt, Artificial Sequence
  Guide Sequence
aagucuaccugacaaaguaug

SEQ ID NO: 6297 - RNA, 21 nt, Artificial Sequence
  Guide Sequence
aagucuaccugacgaaguaug

SEQ ID NO: 6298 - RNA, 21 nt, Artificial Sequence
  Guide Sequence
aauaagucuaccugacaaagu

SEQ ID NO: 6299 - RNA, 21 nt, Artificial Sequence
  Guide Sequence
aauaagucuaccugacgaagu

SEQ ID NO: 6300 - RNA, 21 nt, Artificial Sequence
  Guide Sequence
acaaaguaugggcuuuggaaa

SEQ ID NO: 6301 - RNA, 21 nt, Artificial Sequence
  Guide Sequence
accugacaaaguaugggcuuu

SEQ ID NO: 6302 - RNA, 21 nt, Artificial Sequence
  Guide Sequence
accugacgaaguaugggcuuu

SEQ ID NO: 6303 - RNA, 21 nt, Artificial Sequence
  Guide Sequence
acgaaguaugggcuuuggaaa

SEQ ID NO: 6304 - RNA, 21 nt, Artificial Sequence
  Guide Sequence
acuucgucagguagacuuauu

SEQ ID NO: 6305 - RNA, 21 nt, Artificial Sequence
  Guide Sequence
acuuugucagguagacuuauu

SEQ ID NO: 6306 - RNA, 21 nt, Artificial Sequence
  Guide Sequence
agaaggaaauaagucuaccug

SEQ ID NO: 6307 - RNA, 21 nt, Artificial Sequence
  Guide Sequence
agcauuuccaaagcccauacu

SEQ ID NO: 6308 - RNA, 21 nt, Artificial Sequence
  Guide Sequence
agcccauacuucgucagguag

SEQ ID NO: 6309 - RNA, 21 nt, Artificial Sequence
  Guide Sequence
agcccauacuuugucagguag

SEQ ID NO: 6310 - RNA, 21 nt, Artificial Sequence
  Guide Sequence
aggaaauaagucuaccugaca

SEQ ID NO: 6311 - RNA, 21 nt, Artificial Sequence
  Guide Sequence
aggaaauaagucuaccugacg

SEQ ID NO: 6312 - RNA, 21 nt, Artificial Sequence
  Guide Sequence
agucuaccugacaaaguaugg

SEQ ID NO: 6313 - RNA, 21 nt, Artificial Sequence
  Guide Sequence
agucuaccugacgaaguaugg

SEQ ID NO: 6314 - RNA, 21 nt, Artificial Sequence
  Guide Sequence
auaagucuaccugacaaagua

SEQ ID NO: 6315 - RNA, 21 nt, Artificial Sequence
  Guide Sequence
auaagucuaccugacgaagua

SEQ ID NO: 6316 - RNA, 21 nt, Artificial Sequence
  Guide Sequence
auacuucgucagguagacuua

SEQ ID NO: 6317 - RNA, 21 nt, Artificial Sequence
  Guide Sequence
auacuuugucagguagacuua

SEQ ID NO: 6318 - RNA, 21 nt, Artificial Sequence
  Guide Sequence
auuuccaaagcccauacuucg

SEQ ID NO: 6319 - RNA, 21 nt, Artificial Sequence
  Guide Sequence
auuuccaaagcccauacuuug

SEQ ID NO: 6320 - RNA, 21 nt, Artificial Sequence
  Guide Sequence
caaagcccauacuucgucagg

SEQ ID NO: 6321 - RNA, 21 nt, Artificial Sequence
  Guide Sequence
caaagcccauacuuugucagg

SEQ ID NO: 6322 - RNA, 21 nt, Artificial Sequence
  Guide Sequence
caaaguaugggcuuuggaaau

SEQ ID NO: 6323 - RNA, 21 nt, Artificial Sequence
  Guide Sequence
caagcauuuccaaagcccaua

SEQ ID NO: 6324 - RNA, 21 nt, Artificial Sequence
  Guide Sequence
cauacuucgucagguagacuu

SEQ ID NO: 6325 - RNA, 21 nt, Artificial Sequence
  Guide Sequence
cauacuuugucagguagacuu

SEQ ID NO: 6326 - RNA, 21 nt, Artificial Sequence
  Guide Sequence
cauuuccaaagcccauacuuc

SEQ ID NO: 6327 - RNA, 21 nt, Artificial Sequence
  Guide Sequence
cauuuccaaagcccauacuuu

SEQ ID NO: 6328 - RNA, 21 nt, Artificial Sequence
  Guide Sequence
ccaaagcccauacuucgucag

SEQ ID NO: 6329 - RNA, 21 nt, Artificial Sequence
  Guide Sequence
ccaaagcccauacuuugucag

SEQ ID NO: 6330 - RNA, 21 nt, Artificial Sequence
  Guide Sequence
ccauacuucgucagguagacu

SEQ ID NO: 6331 - RNA, 21 nt, Artificial Sequence
  Guide Sequence
ccauacuuugucagguagacu

SEQ ID NO: 6332 - RNA, 21 nt, Artificial Sequence
  Guide Sequence
cccauacuucgucagguagac

SEQ ID NO: 6333 - RNA, 21 nt, Artificial Sequence
  Guide Sequence
cccauacuuugucagguagac

SEQ ID NO: 6334 - RNA, 21 nt, Artificial Sequence
  Guide Sequence
ccugacaaaguaugggcuuug

SEQ ID NO: 6335 - RNA, 21 nt, Artificial Sequence
  Guide Sequence
ccugacgaaguaugggcuuug

SEQ ID NO: 6336 - RNA, 21 nt, Artificial Sequence
  Guide Sequence
cgaaguaugggcuuuggaaau

SEQ ID NO: 6337 - RNA, 21 nt, Artificial Sequence
  Guide Sequence
cuaccugacaaaguaugggcu

SEQ ID NO: 6338 - RNA, 21 nt, Artificial Sequence
  Guide Sequence
cuaccugacgaaguaugggcu

SEQ ID NO: 6339 - RNA, 21 nt, Artificial Sequence
  Guide Sequence
cugacaaaguaugggcuuugg

SEQ ID NO: 6340 - RNA, 21 nt, Artificial Sequence
  Guide Sequence
cugacgaaguaugggcuuugg

SEQ ID NO: 6341 - RNA, 21 nt, Artificial Sequence
  Guide Sequence
cuucgucagguagacuuauuu

SEQ ID NO: 6342 - RNA, 21 nt, Artificial Sequence
  Guide Sequence
cuuugucagguagacuuauuu

SEQ ID NO: 6343 - RNA, 21 nt, Artificial Sequence
  Guide Sequence
gaaauaagucuaccugacaaa

SEQ ID NO: 6344 - RNA, 21 nt, Artificial Sequence
  Guide Sequence
gaaauaagucuaccugacgaa

SEQ ID NO: 6345 - RNA, 21 nt, Artificial Sequence
  Guide Sequence
gaaggaaauaagucuaccuga

SEQ ID NO: 6346 - RNA, 21 nt, Artificial Sequence
  Guide Sequence
gacaaaguaugggcuuuggaa

SEQ ID NO: 6347 - RNA, 21 nt, Artificial Sequence
  Guide Sequence
gacgaaguaugggcuuuggaa

SEQ ID NO: 6348 - RNA, 21 nt, Artificial Sequence
  Guide Sequence
gagaaggaaauaagucuaccu

SEQ ID NO: 6349 - RNA, 21 nt, Artificial Sequence
  Guide Sequence
gcauuuccaaagcccauacuu

SEQ ID NO: 6350 - RNA, 21 nt, Artificial Sequence
  Guide Sequence
gcccauacuucgucagguaga

SEQ ID NO: 6351 - RNA, 21 nt, Artificial Sequence
  Guide Sequence
gcccauacuuugucagguaga

SEQ ID NO: 6352 - RNA, 21 nt, Artificial Sequence
  Guide Sequence
ggaaauaagucuaccugacaa

SEQ ID NO: 6353 - RNA, 21 nt, Artificial Sequence
  Guide Sequence
ggaaauaagucuaccugacga

SEQ ID NO: 6354 - RNA, 21 nt, Artificial Sequence
  Guide Sequence
gucuaccugacaaaguauggg

SEQ ID NO: 6355 - RNA, 21 nt, Artificial Sequence
  Guide Sequence
gucuaccugacgaaguauggg

SEQ ID NO: 6356 - RNA, 21 nt, Artificial Sequence
  Guide Sequence
uaagucuaccugacaaaguau

SEQ ID NO: 6357 - RNA, 21 nt, Artificial Sequence
  Guide Sequence
uaagucuaccugacgaaguau

SEQ ID NO: 6358 - RNA, 21 nt, Artificial Sequence
  Guide Sequence
uaccugacaaaguaugggcuu

SEQ ID NO: 6359 - RNA, 21 nt, Artificial Sequence
  Guide Sequence
uaccugacgaaguaugggcuu

SEQ ID NO: 6360 - RNA, 21 nt, Artificial Sequence
  Guide Sequence
uacuucgucagguagacuuau

SEQ ID NO: 6361 - RNA, 21 nt, Artificial Sequence
  Guide Sequence
uacuuugucagguagacuuau

SEQ ID NO: 6362 - RNA, 21 nt, Artificial Sequence
  Guide Sequence
uccaaagcccauacuucguca

SEQ ID NO: 6363 - RNA, 21 nt, Artificial Sequence
  Guide Sequence
uccaaagcccauacuuuguca

SEQ ID NO: 6364 - RNA, 21 nt, Artificial Sequence
  Guide Sequence
ucgucagguagacuuauuucc

SEQ ID NO: 6365 - RNA, 21 nt, Artificial Sequence
  Guide Sequence
ucuaccugacaaaguaugggc

SEQ ID NO: 6366 - RNA, 21 nt, Artificial Sequence
  Guide Sequence
ucuaccugacgaaguaugggc

SEQ ID NO: 6367 - RNA, 21 nt, Artificial Sequence
  Guide Sequence
ugacaaaguaugggcuuugga

SEQ ID NO: 6368 - RNA, 21 nt, Artificial Sequence
  Guide Sequence
ugacgaaguaugggcuuugga

SEQ ID NO: 6369 - RNA, 21 nt, Artificial Sequence
  Guide Sequence
uuccaaagcccauacuucguc

SEQ ID NO: 6370 - RNA, 21 nt, Artificial Sequence
  Guide Sequence
uuccaaagcccauacuuuguc

SEQ ID NO: 6371 - RNA, 21 nt, Artificial Sequence
  Guide Sequence
uucgucagguagacuuauuuc

SEQ ID NO: 6372 - RNA, 21 nt, Artificial Sequence
  Guide Sequence
uugucagguagacuuauuucc

SEQ ID NO: 6373 - RNA, 21 nt, Artificial Sequence
  Guide Sequence
uuuccaaagcccauacuucgu

SEQ ID NO: 6374 - RNA, 21 nt, Artificial Sequence
  Guide Sequence
uuuccaaagcccauacuuugu

SEQ ID NO: 6375 - RNA, 21 nt, Artificial Sequence
  Guide Sequence
uuugucagguagacuuauuuc

SEQ ID NO: 6376 - RNA, 22 nt, Artificial Sequence
  Guide Sequence
aaagcccauacuucgucaggua

SEQ ID NO: 6377 - RNA, 22 nt, Artificial Sequence
  Guide Sequence
aaagcccauacuuugucaggua

SEQ ID NO: 6378 - RNA, 22 nt, Artificial Sequence
  Guide Sequence
aaauaagucuaccugacaaagu

SEQ ID NO: 6379 - RNA, 22 nt, Artificial Sequence
  Guide Sequence
aaauaagucuaccugacgaagu

SEQ ID NO: 6380 - RNA, 22 nt, Artificial Sequence
  Guide Sequence
aagcauuuccaaagcccauacu

SEQ ID NO: 6381 - RNA, 22 nt, Artificial Sequence
  Guide Sequence
aagcccauacuucgucagguag

SEQ ID NO: 6382 - RNA, 22 nt, Artificial Sequence
  Guide Sequence
aagcccauacuuugucagguag

SEQ ID NO: 6383 - RNA, 22 nt, Artificial Sequence
  Guide Sequence
aaggaaauaagucuaccugaca

SEQ ID NO: 6384 - RNA, 22 nt, Artificial Sequence
  Guide Sequence
aaggaaauaagucuaccugacg

SEQ ID NO: 6385 - RNA, 22 nt, Artificial Sequence
  Guide Sequence
aagucuaccugacaaaguaugg

SEQ ID NO: 6386 - RNA, 22 nt, Artificial Sequence
  Guide Sequence
aagucuaccugacgaaguaugg

SEQ ID NO: 6387 - RNA, 22 nt, Artificial Sequence
  Guide Sequence
aauaagucuaccugacaaagua

SEQ ID NO: 6388 - RNA, 22 nt, Artificial Sequence
  Guide Sequence
aauaagucuaccugacgaagua

SEQ ID NO: 6389 - RNA, 22 nt, Artificial Sequence
  Guide Sequence
acaaaguaugggcuuuggaaau

SEQ ID NO: 6390 - RNA, 22 nt, Artificial Sequence
  Guide Sequence
accugacaaaguaugggcuuug

SEQ ID NO: 6391 - RNA, 22 nt, Artificial Sequence
  Guide Sequence
accugacgaaguaugggcuuug

SEQ ID NO: 6392 - RNA, 22 nt, Artificial Sequence
  Guide Sequence
acgaaguaugggcuuuggaaau

SEQ ID NO: 6393 - RNA, 22 nt, Artificial Sequence
  Guide Sequence
acuucgucagguagacuuauuu

SEQ ID NO: 6394 - RNA, 22 nt, Artificial Sequence
  Guide Sequence
acuuugucagguagacuuauuu

SEQ ID NO: 6395 - RNA, 22 nt, Artificial Sequence
  Guide Sequence
agaaggaaauaagucuaccuga

SEQ ID NO: 6396 - RNA, 22 nt, Artificial Sequence
  Guide Sequence
agagaaggaaauaagucuaccu

SEQ ID NO: 6397 - RNA, 22 nt, Artificial Sequence
  Guide Sequence
agcauuuccaaagcccauacuu

SEQ ID NO: 6398 - RNA, 22 nt, Artificial Sequence
  Guide Sequence
agcccauacuucgucagguaga

SEQ ID NO: 6399 - RNA, 22 nt, Artificial Sequence
  Guide Sequence
agcccauacuuugucagguaga

SEQ ID NO: 6400 - RNA, 22 nt, Artificial Sequence
  Guide Sequence
aggaaauaagucuaccugacaa

SEQ ID NO: 6401 - RNA, 22 nt, Artificial Sequence
  Guide Sequence
aggaaauaagucuaccugacga

SEQ ID NO: 6402 - RNA, 22 nt, Artificial Sequence
  Guide Sequence
agucuaccugacaaaguauggg

SEQ ID NO: 6403 - RNA, 22 nt, Artificial Sequence
  Guide Sequence
agucuaccugacgaaguauggg

SEQ ID NO: 6404 - RNA, 22 nt, Artificial Sequence
  Guide Sequence
auaagucuaccugacaaaguau

SEQ ID NO: 6405 - RNA, 22 nt, Artificial Sequence
  Guide Sequence
auaagucuaccugacgaaguau

SEQ ID NO: 6406 - RNA, 22 nt, Artificial Sequence
  Guide Sequence
auacuucgucagguagacuuau

SEQ ID NO: 6407 - RNA, 22 nt, Artificial Sequence
  Guide Sequence
auacuuugucagguagacuuau

SEQ ID NO: 6408 - RNA, 22 nt, Artificial Sequence
  Guide Sequence
auuuccaaagcccauacuucgu

SEQ ID NO: 6409 - RNA, 22 nt, Artificial Sequence
  Guide Sequence
auuuccaaagcccauacuuugu

SEQ ID NO: 6410 - RNA, 22 nt, Artificial Sequence
  Guide Sequence
caaagcccauacuucgucaggu

SEQ ID NO: 6411 - RNA, 22 nt, Artificial Sequence
  Guide Sequence
caaagcccauacuuugucaggu

SEQ ID NO: 6412 - RNA, 22 nt, Artificial Sequence
  Guide Sequence
caaaguaugggcuuuggaaaug

SEQ ID NO: 6413 - RNA, 22 nt, Artificial Sequence
  Guide Sequence
caagcauuuccaaagcccauac

SEQ ID NO: 6414 - RNA, 22 nt, Artificial Sequence
  Guide Sequence
cauacuucgucagguagacuua

SEQ ID NO: 6415 - RNA, 22 nt, Artificial Sequence
  Guide Sequence
cauacuuugucagguagacuua

SEQ ID NO: 6416 - RNA, 22 nt, Artificial Sequence
  Guide Sequence
cauuuccaaagcccauacuucg

SEQ ID NO: 6417 - RNA, 22 nt, Artificial Sequence
  Guide Sequence
cauuuccaaagcccauacuuug

SEQ ID NO: 6418 - RNA, 22 nt, Artificial Sequence
  Guide Sequence
ccaaagcccauacuucgucagg

SEQ ID NO: 6419 - RNA, 22 nt, Artificial Sequence
  Guide Sequence
ccaaagcccauacuuugucagg

SEQ ID NO: 6420 - RNA, 22 nt, Artificial Sequence
  Guide Sequence
ccaagcauuuccaaagcccaua

SEQ ID NO: 6421 - RNA, 22 nt, Artificial Sequence
  Guide Sequence
ccauacuucgucagguagacuu

SEQ ID NO: 6422 - RNA, 22 nt, Artificial Sequence
  Guide Sequence
ccauacuuugucagguagacuu

SEQ ID NO: 6423 - RNA, 22 nt, Artificial Sequence
  Guide Sequence
cccauacuucgucagguagacu

SEQ ID NO: 6424 - RNA, 22 nt, Artificial Sequence
  Guide Sequence
cccauacuuugucagguagacu

SEQ ID NO: 6425 - RNA, 22 nt, Artificial Sequence
  Guide Sequence
ccugacaaaguaugggcuuugg

SEQ ID NO: 6426 - RNA, 22 nt, Artificial Sequence
  Guide Sequence
ccugacgaaguaugggcuuugg

SEQ ID NO: 6427 - RNA, 22 nt, Artificial Sequence
  Guide Sequence
cgaaguaugggcuuuggaaaug

SEQ ID NO: 6428 - RNA, 22 nt, Artificial Sequence
  Guide Sequence
cuaccugacaaaguaugggcuu

SEQ ID NO: 6429 - RNA, 22 nt, Artificial Sequence
  Guide Sequence
cuaccugacgaaguaugggcuu

SEQ ID NO: 6430 - RNA, 22 nt, Artificial Sequence
  Guide Sequence
cugacaaaguaugggcuuugga

SEQ ID NO: 6431 - RNA, 22 nt, Artificial Sequence
  Guide Sequence
cugacgaaguaugggcuuugga

SEQ ID NO: 6432 - RNA, 22 nt, Artificial Sequence
  Guide Sequence
cuucgucagguagacuuauuuc

SEQ ID NO: 6433 - RNA, 22 nt, Artificial Sequence
  Guide Sequence
cuuugucagguagacuuauuuc

SEQ ID NO: 6434 - RNA, 22 nt, Artificial Sequence
  Guide Sequence
gaaauaagucuaccugacaaag

SEQ ID NO: 6435 - RNA, 22 nt, Artificial Sequence
  Guide Sequence
gaaauaagucuaccugacgaag

SEQ ID NO: 6436 - RNA, 22 nt, Artificial Sequence
  Guide Sequence
gaaggaaauaagucuaccugac

SEQ ID NO: 6437 - RNA, 22 nt, Artificial Sequence
  Guide Sequence
gacaaaguaugggcuuuggaaa

SEQ ID NO: 6438 - RNA, 22 nt, Artificial Sequence
  Guide Sequence
gacgaaguaugggcuuuggaaa

SEQ ID NO: 6439 - RNA, 22 nt, Artificial Sequence
  Guide Sequence
gagaaggaaauaagucuaccug

SEQ ID NO: 6440 - RNA, 22 nt, Artificial Sequence
  Guide Sequence
gcauuuccaaagcccauacuuc

SEQ ID NO: 6441 - RNA, 22 nt, Artificial Sequence
  Guide Sequence
gcauuuccaaagcccauacuuu

SEQ ID NO: 6442 - RNA, 22 nt, Artificial Sequence
  Guide Sequence
gcccauacuucgucagguagac

SEQ ID NO: 6443 - RNA, 22 nt, Artificial Sequence
  Guide Sequence
gcccauacuuugucagguagac

SEQ ID NO: 6444 - RNA, 22 nt, Artificial Sequence
  Guide Sequence
ggaaauaagucuaccugacaaa

SEQ ID NO: 6445 - RNA, 22 nt, Artificial Sequence
  Guide Sequence
ggaaauaagucuaccugacgaa

SEQ ID NO: 6446 - RNA, 22 nt, Artificial Sequence
  Guide Sequence
gucuaccugacaaaguaugggc

SEQ ID NO: 6447 - RNA, 22 nt, Artificial Sequence
  Guide Sequence
gucuaccugacgaaguaugggc

SEQ ID NO: 6448 - RNA, 22 nt, Artificial Sequence
  Guide Sequence
uaagucuaccugacaaaguaug

SEQ ID NO: 6449 - RNA, 22 nt, Artificial Sequence
  Guide Sequence
uaagucuaccugacgaaguaug

SEQ ID NO: 6450 - RNA, 22 nt, Artificial Sequence
  Guide Sequence
uaccugacaaaguaugggcuuu

SEQ ID NO: 6451 - RNA, 22 nt, Artificial Sequence
  Guide Sequence
uaccugacgaaguaugggcuuu

SEQ ID NO: 6452 - RNA, 22 nt, Artificial Sequence
  Guide Sequence
uacuucgucagguagacuuauu

SEQ ID NO: 6453 - RNA, 22 nt, Artificial Sequence
  Guide Sequence
uacuuugucagguagacuuauu

SEQ ID NO: 6454 - RNA, 22 nt, Artificial Sequence
  Guide Sequence
uccaaagcccauacuucgucag

SEQ ID NO: 6455 - RNA, 22 nt, Artificial Sequence
  Guide Sequence
uccaaagcccauacuuugucag

SEQ ID NO: 6456 - RNA, 22 nt, Artificial Sequence
  Guide Sequence
ucgucagguagacuuauuuccu

SEQ ID NO: 6457 - RNA, 22 nt, Artificial Sequence
  Guide Sequence
ucuaccugacaaaguaugggcu

SEQ ID NO: 6458 - RNA, 22 nt, Artificial Sequence
  Guide Sequence
ucuaccugacgaaguaugggcu

SEQ ID NO: 6459 - RNA, 22 nt, Artificial Sequence
  Guide Sequence
ugacaaaguaugggcuuuggaa

SEQ ID NO: 6460 - RNA, 22 nt, Artificial Sequence
  Guide Sequence
ugacgaaguaugggcuuuggaa

SEQ ID NO: 6461 - RNA, 22 nt, Artificial Sequence
  Guide Sequence
uuccaaagcccauacuucguca

SEQ ID NO: 6462 - RNA, 22 nt, Artificial Sequence
  Guide Sequence
uuccaaagcccauacuuuguca

SEQ ID NO: 6463 - RNA, 22 nt, Artificial Sequence
  Guide Sequence
uucgucagguagacuuauuucc

SEQ ID NO: 6464 - RNA, 22 nt, Artificial Sequence
  Guide Sequence
uugucagguagacuuauuuccu

SEQ ID NO: 6465 - RNA, 22 nt, Artificial Sequence
  Guide Sequence
uuuccaaagcccauacuucguc

SEQ ID NO: 6466 - RNA, 22 nt, Artificial Sequence
  Guide Sequence
uuuccaaagcccauacuuuguc

SEQ ID NO: 6467 - RNA, 22 nt, Artificial Sequence
  Guide Sequence
uuugucagguagacuuauuucc

SEQ ID NO: 6468 - RNA, 20 nt, Artificial Sequence
  Guide Sequence
aaacaagccucgccugccag

SEQ ID NO: 6469 - RNA, 20 nt, Artificial Sequence
  Guide Sequence
aacaagccucgccugccagg

SEQ ID NO: 6470 - RNA, 20 nt, Artificial Sequence
  Guide Sequence
aagccucgccugccaggacc

SEQ ID NO: 6471 - RNA, 20 nt, Artificial Sequence
  Guide Sequence
aagccucgccugccagggac

SEQ ID NO: 6472 - RNA, 20 nt, Artificial Sequence
  Guide Sequence
acaagccucgccugccagga

SEQ ID NO: 6473 - RNA, 20 nt, Artificial Sequence
  Guide Sequence
acaagccucgccugccaggg

SEQ ID NO: 6474 - RNA, 20 nt, Artificial Sequence
  Guide Sequence
agccccaguguuugccgguc

SEQ ID NO: 6475 - RNA, 20 nt, Artificial Sequence
  Guide Sequence
agccucgccugccaggaccg

SEQ ID NO: 6476 - RNA, 20 nt, Artificial Sequence
  Guide Sequence
agccucgccugccagggacc

SEQ ID NO: 6477 - RNA, 20 nt, Artificial Sequence
  Guide Sequence
aggaccggcaaacacugggg

SEQ ID NO: 6478 - RNA, 20 nt, Artificial Sequence
  Guide Sequence
agggaccggcaaacacuggg

SEQ ID NO: 6479 - RNA, 20 nt, Artificial Sequence
  Guide Sequence
aguguuugccggucccuggc

SEQ ID NO: 6480 - RNA, 20 nt, Artificial Sequence
  Guide Sequence
aguguuugccgguccuggca

SEQ ID NO: 6481 - RNA, 20 nt, Artificial Sequence
  Guide Sequence
aucugagccccaguguuugc

SEQ ID NO: 6482 - RNA, 20 nt, Artificial Sequence
  Guide Sequence
caaacaagccucgccugcca

SEQ ID NO: 6483 - RNA, 20 nt, Artificial Sequence
  Guide Sequence
caagccucgccugccaggac

SEQ ID NO: 6484 - RNA, 20 nt, Artificial Sequence
  Guide Sequence
caagccucgccugccaggga

SEQ ID NO: 6485 - RNA, 20 nt, Artificial Sequence
  Guide Sequence
caggaccggcaaacacuggg

SEQ ID NO: 6486 - RNA, 20 nt, Artificial Sequence
  Guide Sequence
cagggaccggcaaacacugg

SEQ ID NO: 6487 - RNA, 20 nt, Artificial Sequence
  Guide Sequence
caguguuugccggucccugg

SEQ ID NO: 6488 - RNA, 20 nt, Artificial Sequence
  Guide Sequence
caguguuugccgguccuggc

SEQ ID NO: 6489 - RNA, 20 nt, Artificial Sequence
  Guide Sequence
ccaaacaagccucgccugcc

SEQ ID NO: 6490 - RNA, 20 nt, Artificial Sequence
  Guide Sequence
ccaggaccggcaaacacugg

SEQ ID NO: 6491 - RNA, 20 nt, Artificial Sequence
  Guide Sequence
ccagggaccggcaaacacug

SEQ ID NO: 6492 - RNA, 20 nt, Artificial Sequence
  Guide Sequence
ccaguguuugccggucccug

SEQ ID NO: 6493 - RNA, 20 nt, Artificial Sequence
  Guide Sequence
ccaguguuugccgguccugg

SEQ ID NO: 6494 - RNA, 20 nt, Artificial Sequence
  Guide Sequence
cccaguguuugccggucccu

SEQ ID NO: 6495 - RNA, 20 nt, Artificial Sequence
  Guide Sequence
cccaguguuugccgguccug

SEQ ID NO: 6496 - RNA, 20 nt, Artificial Sequence
  Guide Sequence
ccccaguguuugccgguccc

SEQ ID NO: 6497 - RNA, 20 nt, Artificial Sequence
  Guide Sequence
ccccaguguuugccgguccu

SEQ ID NO: 6498 - RNA, 20 nt, Artificial Sequence
  Guide Sequence
ccggucccuggcaggcgagg

SEQ ID NO: 6499 - RNA, 20 nt, Artificial Sequence
  Guide Sequence
ccgguccuggcaggcgaggc

SEQ ID NO: 6500 - RNA, 20 nt, Artificial Sequence
  Guide Sequence
ccucgccugccaggaccggc

SEQ ID NO: 6501 - RNA, 20 nt, Artificial Sequence
  Guide Sequence
ccucgccugccagggaccgg

SEQ ID NO: 6502 - RNA, 20 nt, Artificial Sequence
  Guide Sequence
ccugccaggaccggcaaaca

SEQ ID NO: 6503 - RNA, 20 nt, Artificial Sequence
  Guide Sequence
ccugccagggaccggcaaac

SEQ ID NO: 6504 - RNA, 20 nt, Artificial Sequence
  Guide Sequence
cgccugccaggaccggcaaa

SEQ ID NO: 6505 - RNA, 20 nt, Artificial Sequence
  Guide Sequence
cgccugccagggaccggcaa

SEQ ID NO: 6506 - RNA, 20 nt, Artificial Sequence
  Guide Sequence
cggucccuggcaggcgaggc

SEQ ID NO: 6507 - RNA, 20 nt, Artificial Sequence
  Guide Sequence
cgguccuggcaggcgaggcu

SEQ ID NO: 6508 - RNA, 20 nt, Artificial Sequence
  Guide Sequence
cucgccugccaggaccggca

SEQ ID NO: 6509 - RNA, 20 nt, Artificial Sequence
  Guide Sequence
cucgccugccagggaccggc

SEQ ID NO: 6510 - RNA, 20 nt, Artificial Sequence
  Guide Sequence
cugagccccaguguuugccg

SEQ ID NO: 6511 - RNA, 20 nt, Artificial Sequence
  Guide Sequence
cugccaggaccggcaaacac

SEQ ID NO: 6512 - RNA, 20 nt, Artificial Sequence
  Guide Sequence
cugccagggaccggcaaaca

SEQ ID NO: 6513 - RNA, 20 nt, Artificial Sequence
  Guide Sequence
gaccggcaaacacuggggcu

SEQ ID NO: 6514 - RNA, 20 nt, Artificial Sequence
  Guide Sequence
gagccccaguguuugccggu

SEQ ID NO: 6515 - RNA, 20 nt, Artificial Sequence
  Guide Sequence
gccaggaccggcaaacacug

SEQ ID NO: 6516 - RNA, 20 nt, Artificial Sequence
  Guide Sequence
gccagggaccggcaaacacu

SEQ ID NO: 6517 - RNA, 20 nt, Artificial Sequence
  Guide Sequence
gccccaguguuugccggucc

SEQ ID NO: 6518 - RNA, 20 nt, Artificial Sequence
  Guide Sequence
gccggucccuggcaggcgag

SEQ ID NO: 6519 - RNA, 20 nt, Artificial Sequence
  Guide Sequence
gccgguccuggcaggcgagg

SEQ ID NO: 6520 - RNA, 20 nt, Artificial Sequence
  Guide Sequence
gccucgccugccaggaccgg

SEQ ID NO: 6521 - RNA, 20 nt, Artificial Sequence
  Guide Sequence
gccucgccugccagggaccg

SEQ ID NO: 6522 - RNA, 20 nt, Artificial Sequence
  Guide Sequence
gccugccaggaccggcaaac

SEQ ID NO: 6523 - RNA, 20 nt, Artificial Sequence
  Guide Sequence
gccugccagggaccggcaaa

SEQ ID NO: 6524 - RNA, 20 nt, Artificial Sequence
  Guide Sequence
ggaccggcaaacacuggggc

SEQ ID NO: 6525 - RNA, 20 nt, Artificial Sequence
  Guide Sequence
gggaccggcaaacacugggg

SEQ ID NO: 6526 - RNA, 20 nt, Artificial Sequence
  Guide Sequence
ggucccuggcaggcgaggcu

SEQ ID NO: 6527 - RNA, 20 nt, Artificial Sequence
  Guide Sequence
gguccuggcaggcgaggcuu

SEQ ID NO: 6528 - RNA, 20 nt, Artificial Sequence
  Guide Sequence
gucccuggcaggcgaggcuu

SEQ ID NO: 6529 - RNA, 20 nt, Artificial Sequence
  Guide Sequence
guccuggcaggcgaggcuug

SEQ ID NO: 6530 - RNA, 20 nt, Artificial Sequence
  Guide Sequence
guguuugccggucccuggca

SEQ ID NO: 6531 - RNA, 20 nt, Artificial Sequence
  Guide Sequence
guguuugccgguccuggcag

SEQ ID NO: 6532 - RNA, 20 nt, Artificial Sequence
  Guide Sequence
guuugccggucccuggcagg

SEQ ID NO: 6533 - RNA, 20 nt, Artificial Sequence
  Guide Sequence
guuugccgguccuggcaggc

SEQ ID NO: 6534 - RNA, 20 nt, Artificial Sequence
  Guide Sequence
ucgccugccaggaccggcaa

SEQ ID NO: 6535 - RNA, 20 nt, Artificial Sequence
  Guide Sequence
ucgccugccagggaccggca

SEQ ID NO: 6536 - RNA, 20 nt, Artificial Sequence
  Guide Sequence
ucugagccccaguguuugcc

SEQ ID NO: 6537 - RNA, 20 nt, Artificial Sequence
  Guide Sequence
ugagccccaguguuugccgg

SEQ ID NO: 6538 - RNA, 20 nt, Artificial Sequence
  Guide Sequence
ugccaggaccggcaaacacu

SEQ ID NO: 6539 - RNA, 20 nt, Artificial Sequence
  Guide Sequence
ugccagggaccggcaaacac

SEQ ID NO: 6540 - RNA, 20 nt, Artificial Sequence
  Guide Sequence
ugccggucccuggcaggcga

SEQ ID NO: 6541 - RNA, 20 nt, Artificial Sequence
  Guide Sequence
ugccgguccuggcaggcgag

SEQ ID NO: 6542 - RNA, 20 nt, Artificial Sequence
  Guide Sequence
uguuugccggucccuggcag

SEQ ID NO: 6543 - RNA, 20 nt, Artificial Sequence
  Guide Sequence
uguuugccgguccuggcagg

SEQ ID NO: 6544 - RNA, 20 nt, Artificial Sequence
  Guide Sequence
uugccggucccuggcaggcg

SEQ ID NO: 6545 - RNA, 20 nt, Artificial Sequence
  Guide Sequence
uugccgguccuggcaggcga

SEQ ID NO: 6546 - RNA, 20 nt, Artificial Sequence
  Guide Sequence
uuugccggucccuggcaggc

SEQ ID NO: 6547 - RNA, 20 nt, Artificial Sequence
  Guide Sequence
uuugccgguccuggcaggcg

SEQ ID NO: 6548 - RNA, 21 nt, Artificial Sequence
  Guide Sequence
aaacaagccucgccugccagg

SEQ ID NO: 6549 - RNA, 21 nt, Artificial Sequence
  Guide Sequence
aacaagccucgccugccagga

SEQ ID NO: 6550 - RNA, 21 nt, Artificial Sequence
  Guide Sequence
aacaagccucgccugccaggg

SEQ ID NO: 6551 - RNA, 21 nt, Artificial Sequence
  Guide Sequence
aagccucgccugccaggaccg

SEQ ID NO: 6552 - RNA, 21 nt, Artificial Sequence
  Guide Sequence
aagccucgccugccagggacc

SEQ ID NO: 6553 - RNA, 21 nt, Artificial Sequence
  Guide Sequence
acaagccucgccugccaggac

SEQ ID NO: 6554 - RNA, 21 nt, Artificial Sequence
  Guide Sequence
acaagccucgccugccaggga

SEQ ID NO: 6555 - RNA, 21 nt, Artificial Sequence
  Guide Sequence
agccccaguguuugccggucc

SEQ ID NO: 6556 - RNA, 21 nt, Artificial Sequence
  Guide Sequence
agccucgccugccaggaccgg

SEQ ID NO: 6557 - RNA, 21 nt, Artificial Sequence
  Guide Sequence
agccucgccugccagggaccg

SEQ ID NO: 6558 - RNA, 21 nt, Artificial Sequence
  Guide Sequence
aggaccggcaaacacuggggc

SEQ ID NO: 6559 - RNA, 21 nt, Artificial Sequence
  Guide Sequence
agggaccggcaaacacugggg

SEQ ID NO: 6560 - RNA, 21 nt, Artificial Sequence
  Guide Sequence
aguguuugccggucccuggca

SEQ ID NO: 6561 - RNA, 21 nt, Artificial Sequence
  Guide Sequence
aguguuugccgguccuggcag

SEQ ID NO: 6562 - RNA, 21 nt, Artificial Sequence
  Guide Sequence
aucugagccccaguguuugcc

SEQ ID NO: 6563 - RNA, 21 nt, Artificial Sequence
  Guide Sequence
caaacaagccucgccugccag

SEQ ID NO: 6564 - RNA, 21 nt, Artificial Sequence
  Guide Sequence
caagccucgccugccaggacc

SEQ ID NO: 6565 - RNA, 21 nt, Artificial Sequence
  Guide Sequence
caagccucgccugccagggac

SEQ ID NO: 6566 - RNA, 21 nt, Artificial Sequence
  Guide Sequence
caggaccggcaaacacugggg

SEQ ID NO: 6567 - RNA, 21 nt, Artificial Sequence
  Guide Sequence
cagggaccggcaaacacuggg

SEQ ID NO: 6568 - RNA, 21 nt, Artificial Sequence
  Guide Sequence
caguguuugccggucccuggc

SEQ ID NO: 6569 - RNA, 21 nt, Artificial Sequence
  Guide Sequence
caguguuugccgguccuggca

SEQ ID NO: 6570 - RNA, 21 nt, Artificial Sequence
  Guide Sequence
caucugagccccaguguuugc

SEQ ID NO: 6571 - RNA, 21 nt, Artificial Sequence
  Guide Sequence
ccaaacaagccucgccugcca

SEQ ID NO: 6572 - RNA, 21 nt, Artificial Sequence
  Guide Sequence
ccaggaccggcaaacacuggg

SEQ ID NO: 6573 - RNA, 21 nt, Artificial Sequence
  Guide Sequence
ccagggaccggcaaacacugg

SEQ ID NO: 6574 - RNA, 21 nt, Artificial Sequence
  Guide Sequence
ccaguguuugccggucccugg

SEQ ID NO: 6575 - RNA, 21 nt, Artificial Sequence
  Guide Sequence
ccaguguuugccgguccuggc

SEQ ID NO: 6576 - RNA, 21 nt, Artificial Sequence
  Guide Sequence
cccaaacaagccucgccugcc

SEQ ID NO: 6577 - RNA, 21 nt, Artificial Sequence
  Guide Sequence
cccaguguuugccggucccug

SEQ ID NO: 6578 - RNA, 21 nt, Artificial Sequence
  Guide Sequence
cccaguguuugccgguccugg

SEQ ID NO: 6579 - RNA, 21 nt, Artificial Sequence
  Guide Sequence
ccccaguguuugccggucccu

SEQ ID NO: 6580 - RNA, 21 nt, Artificial Sequence
  Guide Sequence
ccccaguguuugccgguccug

SEQ ID NO: 6581 - RNA, 21 nt, Artificial Sequence
  Guide Sequence
ccgguccuggcaggcgaggcu

SEQ ID NO: 6582 - RNA, 21 nt, Artificial Sequence
  Guide Sequence
ccucgccugccaggaccggca

SEQ ID NO: 6583 - RNA, 21 nt, Artificial Sequence
  Guide Sequence
ccugccaggaccggcaaacac

SEQ ID NO: 6584 - RNA, 21 nt, Artificial Sequence
  Guide Sequence
ccugccagggaccggcaaaca

SEQ ID NO: 6585 - RNA, 21 nt, Artificial Sequence
  Guide Sequence
cgccugccaggaccggcaaac

SEQ ID NO: 6586 - RNA, 21 nt, Artificial Sequence
  Guide Sequence
cgccugccagggaccggcaaa

SEQ ID NO: 6587 - RNA, 21 nt, Artificial Sequence
  Guide Sequence
cggucccuggcaggcgaggcu

SEQ ID NO: 6588 - RNA, 21 nt, Artificial Sequence
  Guide Sequence
cgguccuggcaggcgaggcuu

SEQ ID NO: 6589 - RNA, 21 nt, Artificial Sequence
  Guide Sequence
cucgccugccaggaccggcaa

SEQ ID NO: 6590 - RNA, 21 nt, Artificial Sequence
  Guide Sequence
cucgccugccagggaccggca

SEQ ID NO: 6591 - RNA, 21 nt, Artificial Sequence
  Guide Sequence
cugagccccaguguuugccgg

SEQ ID NO: 6592 - RNA, 21 nt, Artificial Sequence
  Guide Sequence
cugccaggaccggcaaacacu

SEQ ID NO: 6593 - RNA, 21 nt, Artificial Sequence
  Guide Sequence
cugccagggaccggcaaacac

SEQ ID NO: 6594 - RNA, 21 nt, Artificial Sequence
  Guide Sequence
gaccggcaaacacuggggcuc

SEQ ID NO: 6595 - RNA, 21 nt, Artificial Sequence
  Guide Sequence
gagccccaguguuugccgguc

SEQ ID NO: 6596 - RNA, 21 nt, Artificial Sequence
  Guide Sequence
gccaggaccggcaaacacugg

SEQ ID NO: 6597 - RNA, 21 nt, Artificial Sequence
  Guide Sequence
gccagggaccggcaaacacug

SEQ ID NO: 6598 - RNA, 21 nt, Artificial Sequence
  Guide Sequence
gccccaguguuugccgguccc

SEQ ID NO: 6599 - RNA, 21 nt, Artificial Sequence
  Guide Sequence
gccccaguguuugccgguccu

SEQ ID NO: 6600 - RNA, 21 nt, Artificial Sequence
  Guide Sequence
gccugccaggaccggcaaaca

SEQ ID NO: 6601 - RNA, 21 nt, Artificial Sequence
  Guide Sequence
gccugccagggaccggcaaac

SEQ ID NO: 6602 - RNA, 21 nt, Artificial Sequence
  Guide Sequence
ggaccggcaaacacuggggcu

SEQ ID NO: 6603 - RNA, 21 nt, Artificial Sequence
  Guide Sequence
gggaccggcaaacacuggggc

SEQ ID NO: 6604 - RNA, 21 nt, Artificial Sequence
  Guide Sequence
ggucccuggcaggcgaggcuu

SEQ ID NO: 6605 - RNA, 21 nt, Artificial Sequence
  Guide Sequence
gguccuggcaggcgaggcuug

SEQ ID NO: 6606 - RNA, 21 nt, Artificial Sequence
  Guide Sequence
gucccuggcaggcgaggcuug

SEQ ID NO: 6607 - RNA, 21 nt, Artificial Sequence
  Guide Sequence
guccuggcaggcgaggcuugu

SEQ ID NO: 6608 - RNA, 21 nt, Artificial Sequence
  Guide Sequence
guguuugccggucccuggcag

SEQ ID NO: 6609 - RNA, 21 nt, Artificial Sequence
  Guide Sequence
guguuugccgguccuggcagg

SEQ ID NO: 6610 - RNA, 21 nt, Artificial Sequence
  Guide Sequence
guuugccggucccuggcaggc

SEQ ID NO: 6611 - RNA, 21 nt, Artificial Sequence
  Guide Sequence
guuugccgguccuggcaggcg

SEQ ID NO: 6612 - RNA, 21 nt, Artificial Sequence
  Guide Sequence
ucgccugccaggaccggcaaa

SEQ ID NO: 6613 - RNA, 21 nt, Artificial Sequence
  Guide Sequence
ucgccugccagggaccggcaa

SEQ ID NO: 6614 - RNA, 21 nt, Artificial Sequence
  Guide Sequence
ucugagccccaguguuugccg

SEQ ID NO: 6615 - RNA, 21 nt, Artificial Sequence
  Guide Sequence
ugagccccaguguuugccggu

SEQ ID NO: 6616 - RNA, 21 nt, Artificial Sequence
  Guide Sequence
ugccaggaccggcaaacacug

SEQ ID NO: 6617 - RNA, 21 nt, Artificial Sequence
  Guide Sequence
ugccagggaccggcaaacacu

SEQ ID NO: 6618 - RNA, 21 nt, Artificial Sequence
  Guide Sequence
ugccggucccuggcaggcgag

SEQ ID NO: 6619 - RNA, 21 nt, Artificial Sequence
  Guide Sequence
ugccgguccuggcaggcgagg

SEQ ID NO: 6620 - RNA, 21 nt, Artificial Sequence
  Guide Sequence
uguuugccggucccuggcagg

SEQ ID NO: 6621 - RNA, 21 nt, Artificial Sequence
  Guide Sequence
uguuugccgguccuggcaggc

SEQ ID NO: 6622 - RNA, 21 nt, Artificial Sequence
  Guide Sequence
uugccggucccuggcaggcga

SEQ ID NO: 6623 - RNA, 21 nt, Artificial Sequence
  Guide Sequence
uugccgguccuggcaggcgag

SEQ ID NO: 6624 - RNA, 21 nt, Artificial Sequence
  Guide Sequence
uuugccggucccuggcaggcg

SEQ ID NO: 6625 - RNA, 21 nt, Artificial Sequence
  Guide Sequence
uuugccgguccuggcaggcga

SEQ ID NO: 6626 - RNA, 22 nt, Artificial Sequence
  Guide Sequence
aaacaagccucgccugccagga

SEQ ID NO: 6627 - RNA, 22 nt, Artificial Sequence
  Guide Sequence
aaacaagccucgccugccaggg

SEQ ID NO: 6628 - RNA, 22 nt, Artificial Sequence
  Guide Sequence
aacaagccucgccugccaggac

SEQ ID NO: 6629 - RNA, 22 nt, Artificial Sequence
  Guide Sequence
aacaagccucgccugccaggga

SEQ ID NO: 6630 - RNA, 22 nt, Artificial Sequence
  Guide Sequence
aagccucgccugccaggaccgg

SEQ ID NO: 6631 - RNA, 22 nt, Artificial Sequence
  Guide Sequence
aagccucgccugccagggaccg

SEQ ID NO: 6632 - RNA, 22 nt, Artificial Sequence
  Guide Sequence
acaagccucgccugccaggacc

SEQ ID NO: 6633 - RNA, 22 nt, Artificial Sequence
  Guide Sequence
acaagccucgccugccagggac

SEQ ID NO: 6634 - RNA, 22 nt, Artificial Sequence
  Guide Sequence
agccccaguguuugccgguccc

SEQ ID NO: 6635 - RNA, 22 nt, Artificial Sequence
  Guide Sequence
agccccaguguuugccgguccu

SEQ ID NO: 6636 - RNA, 22 nt, Artificial Sequence
  Guide Sequence
agccucgccugccaggaccggc

SEQ ID NO: 6637 - RNA, 22 nt, Artificial Sequence
  Guide Sequence
agccucgccugccagggaccgg

SEQ ID NO: 6638 - RNA, 22 nt, Artificial Sequence
  Guide Sequence
aggaccggcaaacacuggggcu

SEQ ID NO: 6639 - RNA, 22 nt, Artificial Sequence
  Guide Sequence
agggaccggcaaacacuggggc

SEQ ID NO: 6640 - RNA, 22 nt, Artificial Sequence
  Guide Sequence
aguguuugccggucccuggcag

SEQ ID NO: 6641 - RNA, 22 nt, Artificial Sequence
  Guide Sequence
aguguuugccgguccuggcagg

SEQ ID NO: 6642 - RNA, 22 nt, Artificial Sequence
  Guide Sequence
aucugagccccaguguuugccg

SEQ ID NO: 6643 - RNA, 22 nt, Artificial Sequence
  Guide Sequence
caaacaagccucgccugccagg

SEQ ID NO: 6644 - RNA, 22 nt, Artificial Sequence
  Guide Sequence
caagccucgccugccaggaccg

SEQ ID NO: 6645 - RNA, 22 nt, Artificial Sequence
  Guide Sequence
caagccucgccugccagggacc

SEQ ID NO: 6646 - RNA, 22 nt, Artificial Sequence
  Guide Sequence
caggaccggcaaacacuggggc

SEQ ID NO: 6647 - RNA, 22 nt, Artificial Sequence
  Guide Sequence
cagggaccggcaaacacugggg

SEQ ID NO: 6648 - RNA, 22 nt, Artificial Sequence
  Guide Sequence
caguguuugccggucccuggca

SEQ ID NO: 6649 - RNA, 22 nt, Artificial Sequence
  Guide Sequence
caguguuugccgguccuggcag

SEQ ID NO: 6650 - RNA, 22 nt, Artificial Sequence
  Guide Sequence
caucugagccccaguguuugcc

SEQ ID NO: 6651 - RNA, 22 nt, Artificial Sequence
  Guide Sequence
ccaaacaagccucgccugccag

SEQ ID NO: 6652 - RNA, 22 nt, Artificial Sequence
  Guide Sequence
ccaggaccggcaaacacugggg

SEQ ID NO: 6653 - RNA, 22 nt, Artificial Sequence
  Guide Sequence
ccagggaccggcaaacacuggg

SEQ ID NO: 6654 - RNA, 22 nt, Artificial Sequence
  Guide Sequence
ccaguguuugccggucccuggc

SEQ ID NO: 6655 - RNA, 22 nt, Artificial Sequence
  Guide Sequence
ccaguguuugccgguccuggca

SEQ ID NO: 6656 - RNA, 22 nt, Artificial Sequence
  Guide Sequence
ccaucugagccccaguguuugc

SEQ ID NO: 6657 - RNA, 22 nt, Artificial Sequence
  Guide Sequence
cccaaacaagccucgccugcca

SEQ ID NO: 6658 - RNA, 22 nt, Artificial Sequence
  Guide Sequence
cccaguguuugccggucccugg

SEQ ID NO: 6659 - RNA, 22 nt, Artificial Sequence
  Guide Sequence
cccaguguuugccgguccuggc

SEQ ID NO: 6660 - RNA, 22 nt, Artificial Sequence
  Guide Sequence
ccccaaacaagccucgccugcc

SEQ ID NO: 6661 - RNA, 22 nt, Artificial Sequence
  Guide Sequence
ccccaguguuugccggucccug

SEQ ID NO: 6662 - RNA, 22 nt, Artificial Sequence
  Guide Sequence
ccccaguguuugccgguccugg

SEQ ID NO: 6663 - RNA, 22 nt, Artificial Sequence
  Guide Sequence
ccggucccuggcaggcgaggcu

SEQ ID NO: 6664 - RNA, 22 nt, Artificial Sequence
  Guide Sequence
ccgguccuggcaggcgaggcuu

SEQ ID NO: 6665 - RNA, 22 nt, Artificial Sequence
  Guide Sequence
ccucgccugccaggaccggcaa

SEQ ID NO: 6666 - RNA, 22 nt, Artificial Sequence
  Guide Sequence
ccucgccugccagggaccggca

SEQ ID NO: 6667 - RNA, 22 nt, Artificial Sequence
  Guide Sequence
ccugccaggaccggcaaacacu

SEQ ID NO: 6668 - RNA, 22 nt, Artificial Sequence
  Guide Sequence
ccugccagggaccggcaaacac

SEQ ID NO: 6669 - RNA, 22 nt, Artificial Sequence
  Guide Sequence
cgccugccaggaccggcaaaca

SEQ ID NO: 6670 - RNA, 22 nt, Artificial Sequence
  Guide Sequence
cgccugccagggaccggcaaac

SEQ ID NO: 6671 - RNA, 22 nt, Artificial Sequence
  Guide Sequence
cggucccuggcaggcgaggcuu

SEQ ID NO: 6672 - RNA, 22 nt, Artificial Sequence
  Guide Sequence
cgguccuggcaggcgaggcuug

SEQ ID NO: 6673 - RNA, 22 nt, Artificial Sequence
  Guide Sequence
cucgccugccaggaccggcaaa

SEQ ID NO: 6674 - RNA, 22 nt, Artificial Sequence
  Guide Sequence
cucgccugccagggaccggcaa

SEQ ID NO: 6675 - RNA, 22 nt, Artificial Sequence
  Guide Sequence
cugagccccaguguuugccggu

SEQ ID NO: 6676 - RNA, 22 nt, Artificial Sequence
  Guide Sequence
cugccaggaccggcaaacacug

SEQ ID NO: 6677 - RNA, 22 nt, Artificial Sequence
  Guide Sequence
cugccagggaccggcaaacacu

SEQ ID NO: 6678 - RNA, 22 nt, Artificial Sequence
  Guide Sequence
gaccggcaaacacuggggcuca

SEQ ID NO: 6679 - RNA, 22 nt, Artificial Sequence
  Guide Sequence
gagccccaguguuugccggucc

SEQ ID NO: 6680 - RNA, 22 nt, Artificial Sequence
  Guide Sequence
gccaggaccggcaaacacuggg

SEQ ID NO: 6681 - RNA, 22 nt, Artificial Sequence
  Guide Sequence
gccagggaccggcaaacacugg

SEQ ID NO: 6682 - RNA, 22 nt, Artificial Sequence
  Guide Sequence
gccccaguguuugccggucccu

SEQ ID NO: 6683 - RNA, 22 nt, Artificial Sequence
  Guide Sequence
gccccaguguuugccgguccug

SEQ ID NO: 6684 - RNA, 22 nt, Artificial Sequence
  Guide Sequence
gccgguccuggcaggcgaggcu

SEQ ID NO: 6685 - RNA, 22 nt, Artificial Sequence
  Guide Sequence
gccucgccugccaggaccggca

SEQ ID NO: 6686 - RNA, 22 nt, Artificial Sequence
  Guide Sequence
gccugccaggaccggcaaacac

SEQ ID NO: 6687 - RNA, 22 nt, Artificial Sequence
  Guide Sequence
gccugccagggaccggcaaaca

SEQ ID NO: 6688 - RNA, 22 nt, Artificial Sequence
  Guide Sequence
ggaccggcaaacacuggggcuc

SEQ ID NO: 6689 - RNA, 22 nt, Artificial Sequence
  Guide Sequence
gggaccggcaaacacuggggcu

SEQ ID NO: 6690 - RNA, 22 nt, Artificial Sequence
  Guide Sequence
ggucccuggcaggcgaggcuug

SEQ ID NO: 6691 - RNA, 22 nt, Artificial Sequence
  Guide Sequence
gguccuggcaggcgaggcuugu

SEQ ID NO: 6692 - RNA, 22 nt, Artificial Sequence
  Guide Sequence
gucccuggcaggcgaggcuugu

SEQ ID NO: 6693 - RNA, 22 nt, Artificial Sequence
  Guide Sequence
guccuggcaggcgaggcuuguu

SEQ ID NO: 6694 - RNA, 22 nt, Artificial Sequence
  Guide Sequence
guguuugccggucccuggcagg

SEQ ID NO: 6695 - RNA, 22 nt, Artificial Sequence
  Guide Sequence
guguuugccgguccuggcaggc

SEQ ID NO: 6696 - RNA, 22 nt, Artificial Sequence
  Guide Sequence
guuugccggucccuggcaggcg

SEQ ID NO: 6697 - RNA, 22 nt, Artificial Sequence
  Guide Sequence
guuugccgguccuggcaggcga

SEQ ID NO: 6698 - RNA, 22 nt, Artificial Sequence
  Guide Sequence
ucgccugccaggaccggcaaac

SEQ ID NO: 6699 - RNA, 22 nt, Artificial Sequence
  Guide Sequence
ucgccugccagggaccggcaaa

SEQ ID NO: 6700 - RNA, 22 nt, Artificial Sequence
  Guide Sequence
ucugagccccaguguuugccgg

SEQ ID NO: 6701 - RNA, 22 nt, Artificial Sequence
  Guide Sequence
ugagccccaguguuugccgguc

SEQ ID NO: 6702 - RNA, 22 nt, Artificial Sequence
  Guide Sequence
ugccaggaccggcaaacacugg

SEQ ID NO: 6703 - RNA, 22 nt, Artificial Sequence
  Guide Sequence
ugccagggaccggcaaacacug

SEQ ID NO: 6704 - RNA, 22 nt, Artificial Sequence
  Guide Sequence
ugccggucccuggcaggcgagg

SEQ ID NO: 6705 - RNA, 22 nt, Artificial Sequence
  Guide Sequence
ugccgguccuggcaggcgaggc

SEQ ID NO: 6706 - RNA, 22 nt, Artificial Sequence
  Guide Sequence
uguuugccggucccuggcaggc

SEQ ID NO: 6707 - RNA, 22 nt, Artificial Sequence
  Guide Sequence
uguuugccgguccuggcaggcg

SEQ ID NO: 6708 - RNA, 22 nt, Artificial Sequence
  Guide Sequence
uugccggucccuggcaggcgag

SEQ ID NO: 6709 - RNA, 22 nt, Artificial Sequence
  Guide Sequence
uugccgguccuggcaggcgagg

SEQ ID NO: 6710 - RNA, 22 nt, Artificial Sequence
  Guide Sequence
uuugccggucccuggcaggcga

SEQ ID NO: 6711 - RNA, 22 nt, Artificial Sequence
  Guide Sequence
uuugccgguccuggcaggcgag

SEQ ID NO: 6712 - RNA, 20 nt, Artificial Sequence
  Guide Sequence
aaacaagccuccccugccag

SEQ ID NO: 6713 - RNA, 20 nt, Artificial Sequence
  Guide Sequence
aacaagccuccccugccagg

SEQ ID NO: 6714 - RNA, 20 nt, Artificial Sequence
  Guide Sequence
aagccuccccugccagggac

SEQ ID NO: 6715 - RNA, 20 nt, Artificial Sequence
  Guide Sequence
acaagccuccccugccaggg

SEQ ID NO: 6716 - RNA, 20 nt, Artificial Sequence
  Guide Sequence
acggaggccccaaacaagcc

SEQ ID NO: 6717 - RNA, 20 nt, Artificial Sequence
  Guide Sequence
agccuccccugccagggacc

SEQ ID NO: 6718 - RNA, 20 nt, Artificial Sequence
  Guide Sequence
aggccccaaacaagccuccc

SEQ ID NO: 6719 - RNA, 20 nt, Artificial Sequence
  Guide Sequence
aggccccaaacaagccucgc

SEQ ID NO: 6720 - RNA, 20 nt, Artificial Sequence
  Guide Sequence
aggcgaggcuuguuuggggc

SEQ ID NO: 6721 - RNA, 20 nt, Artificial Sequence
  Guide Sequence
aggggaggcuuguuuggggc

SEQ ID NO: 6722 - RNA, 20 nt, Artificial Sequence
  Guide Sequence
caaacaagccuccccugcca

SEQ ID NO: 6723 - RNA, 20 nt, Artificial Sequence
  Guide Sequence
caagccuccccugccaggga

SEQ ID NO: 6724 - RNA, 20 nt, Artificial Sequence
  Guide Sequence
cacggaggccccaaacaagc

SEQ ID NO: 6725 - RNA, 20 nt, Artificial Sequence
  Guide Sequence
caggcgaggcuuguuugggg

SEQ ID NO: 6726 - RNA, 20 nt, Artificial Sequence
  Guide Sequence
caggggaggcuuguuugggg

SEQ ID NO: 6727 - RNA, 20 nt, Artificial Sequence
  Guide Sequence
ccaaacaagccuccccugcc

SEQ ID NO: 6728 - RNA, 20 nt, Artificial Sequence
  Guide Sequence
cccaaacaagccuccccugc

SEQ ID NO: 6729 - RNA, 20 nt, Artificial Sequence
  Guide Sequence
cccaaacaagccucgccugc

SEQ ID NO: 6730 - RNA, 20 nt, Artificial Sequence
  Guide Sequence
ccccaaacaagccuccccug

SEQ ID NO: 6731 - RNA, 20 nt, Artificial Sequence
  Guide Sequence
ccccaaacaagccucgccug

SEQ ID NO: 6732 - RNA, 20 nt, Artificial Sequence
  Guide Sequence
ccccugccagggaccggcaa

SEQ ID NO: 6733 - RNA, 20 nt, Artificial Sequence
  Guide Sequence
cccuggcaggcgaggcuugu

SEQ ID NO: 6734 - RNA, 20 nt, Artificial Sequence
  Guide Sequence
cccuggcaggggaggcuugu

SEQ ID NO: 6735 - RNA, 20 nt, Artificial Sequence
  Guide Sequence
ccggucccuggcaggggagg

SEQ ID NO: 6736 - RNA, 20 nt, Artificial Sequence
  Guide Sequence
ccuccccugccagggaccgg

SEQ ID NO: 6737 - RNA, 20 nt, Artificial Sequence
  Guide Sequence
ccuggcaggcgaggcuuguu

SEQ ID NO: 6738 - RNA, 20 nt, Artificial Sequence
  Guide Sequence
ccuggcaggggaggcuuguu

SEQ ID NO: 6739 - RNA, 20 nt, Artificial Sequence
  Guide Sequence
cggaggccccaaacaagccu

SEQ ID NO: 6740 - RNA, 20 nt, Artificial Sequence
  Guide Sequence
cggucccuggcaggggaggc

SEQ ID NO: 6741 - RNA, 20 nt, Artificial Sequence
  Guide Sequence
cuccccugccagggaccggc

SEQ ID NO: 6742 - RNA, 20 nt, Artificial Sequence
  Guide Sequence
cuggcaggcgaggcuuguuu

SEQ ID NO: 6743 - RNA, 20 nt, Artificial Sequence
  Guide Sequence
cuggcaggggaggcuuguuu

SEQ ID NO: 6744 - RNA, 20 nt, Artificial Sequence
  Guide Sequence
gaggccccaaacaagccucc

SEQ ID NO: 6745 - RNA, 20 nt, Artificial Sequence
  Guide Sequence
gaggccccaaacaagccucg

SEQ ID NO: 6746 - RNA, 20 nt, Artificial Sequence
  Guide Sequence
gcaggcgaggcuuguuuggg

SEQ ID NO: 6747 - RNA, 20 nt, Artificial Sequence
  Guide Sequence
gcaggggaggcuuguuuggg

SEQ ID NO: 6748 - RNA, 20 nt, Artificial Sequence
  Guide Sequence
gccccaaacaagccuccccu

SEQ ID NO: 6749 - RNA, 20 nt, Artificial Sequence
  Guide Sequence
gccccaaacaagccucgccu

SEQ ID NO: 6750 - RNA, 20 nt, Artificial Sequence
  Guide Sequence
gccggucccuggcaggggag

SEQ ID NO: 6751 - RNA, 20 nt, Artificial Sequence
  Guide Sequence
gccuccccugccagggaccg

SEQ ID NO: 6752 - RNA, 20 nt, Artificial Sequence
  Guide Sequence
gcgaggcuuguuuggggccu

SEQ ID NO: 6753 - RNA, 20 nt, Artificial Sequence
  Guide Sequence
ggaggccccaaacaagccuc

SEQ ID NO: 6754 - RNA, 20 nt, Artificial Sequence
  Guide Sequence
ggcaggcgaggcuuguuugg

SEQ ID NO: 6755 - RNA, 20 nt, Artificial Sequence
  Guide Sequence
ggcaggggaggcuuguuugg

SEQ ID NO: 6756 - RNA, 20 nt, Artificial Sequence
  Guide Sequence
ggccccaaacaagccucccc

SEQ ID NO: 6757 - RNA, 20 nt, Artificial Sequence
  Guide Sequence
ggccccaaacaagccucgcc

SEQ ID NO: 6758 - RNA, 20 nt, Artificial Sequence
  Guide Sequence
ggcgaggcuuguuuggggcc

SEQ ID NO: 6759 - RNA, 20 nt, Artificial Sequence
  Guide Sequence
gggaggcuuguuuggggccu

SEQ ID NO: 6760 - RNA, 20 nt, Artificial Sequence
  Guide Sequence
ggggaggcuuguuuggggcc

SEQ ID NO: 6761 - RNA, 20 nt, Artificial Sequence
  Guide Sequence
ggucccuggcaggggaggcu

SEQ ID NO: 6762 - RNA, 20 nt, Artificial Sequence
  Guide Sequence
gucccuggcaggggaggcuu

SEQ ID NO: 6763 - RNA, 20 nt, Artificial Sequence
  Guide Sequence
uccccugccagggaccggca

SEQ ID NO: 6764 - RNA, 20 nt, Artificial Sequence
  Guide Sequence
ucccuggcaggcgaggcuug

SEQ ID NO: 6765 - RNA, 20 nt, Artificial Sequence
  Guide Sequence
ucccuggcaggggaggcuug

SEQ ID NO: 6766 - RNA, 20 nt, Artificial Sequence
  Guide Sequence
ugccggucccuggcagggga

SEQ ID NO: 6767 - RNA, 20 nt, Artificial Sequence
  Guide Sequence
uggcaggcgaggcuuguuug

SEQ ID NO: 6768 - RNA, 20 nt, Artificial Sequence
  Guide Sequence
uggcaggggaggcuuguuug

SEQ ID NO: 6769 - RNA, 20 nt, Artificial Sequence
  Guide Sequence
uugccggucccuggcagggg

SEQ ID NO: 6770 - RNA, 20 nt, Artificial Sequence
  Guide Sequence
uuugccggucccuggcaggg

SEQ ID NO: 6771 - RNA, 21 nt, Artificial Sequence
  Guide Sequence
aaacaagccuccccugccagg

SEQ ID NO: 6772 - RNA, 21 nt, Artificial Sequence
  Guide Sequence
aacaagccuccccugccaggg

SEQ ID NO: 6773 - RNA, 21 nt, Artificial Sequence
  Guide Sequence
aagccuccccugccagggacc

SEQ ID NO: 6774 - RNA, 21 nt, Artificial Sequence
  Guide Sequence
acaagccuccccugccaggga

SEQ ID NO: 6775 - RNA, 21 nt, Artificial Sequence
  Guide Sequence
acggaggccccaaacaagccu

SEQ ID NO: 6776 - RNA, 21 nt, Artificial Sequence
  Guide Sequence
agccuccccugccagggaccg

SEQ ID NO: 6777 - RNA, 21 nt, Artificial Sequence
  Guide Sequence
aggccccaaacaagccucccc

SEQ ID NO: 6778 - RNA, 21 nt, Artificial Sequence
  Guide Sequence
aggccccaaacaagccucgcc

SEQ ID NO: 6779 - RNA, 21 nt, Artificial Sequence
  Guide Sequence
aggcgaggcuuguuuggggcc

SEQ ID NO: 6780 - RNA, 21 nt, Artificial Sequence
  Guide Sequence
aggggaggcuuguuuggggcc

SEQ ID NO: 6781 - RNA, 21 nt, Artificial Sequence
  Guide Sequence
caaacaagccuccccugccag

SEQ ID NO: 6782 - RNA, 21 nt, Artificial Sequence
  Guide Sequence
caagccuccccugccagggac

SEQ ID NO: 6783 - RNA, 21 nt, Artificial Sequence
  Guide Sequence
cacggaggccccaaacaagcc

SEQ ID NO: 6784 - RNA, 21 nt, Artificial Sequence
  Guide Sequence
caggcgaggcuuguuuggggc

SEQ ID NO: 6785 - RNA, 21 nt, Artificial Sequence
  Guide Sequence
caggggaggcuuguuuggggc

SEQ ID NO: 6786 - RNA, 21 nt, Artificial Sequence
  Guide Sequence
ccaaacaagccuccccugcca

SEQ ID NO: 6787 - RNA, 21 nt, Artificial Sequence
  Guide Sequence
ccacggaggccccaaacaagc

SEQ ID NO: 6788 - RNA, 21 nt, Artificial Sequence
  Guide Sequence
cccaaacaagccuccccugcc

SEQ ID NO: 6789 - RNA, 21 nt, Artificial Sequence
  Guide Sequence
ccccaaacaagccuccccugc

SEQ ID NO: 6790 - RNA, 21 nt, Artificial Sequence
  Guide Sequence
ccccaaacaagccucgccugc

SEQ ID NO: 6791 - RNA, 21 nt, Artificial Sequence
  Guide Sequence
ccccugccagggaccggcaaa

SEQ ID NO: 6792 - RNA, 21 nt, Artificial Sequence
  Guide Sequence
cccuggcaggcgaggcuuguu

SEQ ID NO: 6793 - RNA, 21 nt, Artificial Sequence
  Guide Sequence
cccuggcaggggaggcuuguu

SEQ ID NO: 6794 - RNA, 21 nt, Artificial Sequence
  Guide Sequence
ccuggcaggcgaggcuuguuu

SEQ ID NO: 6795 - RNA, 21 nt, Artificial Sequence
  Guide Sequence
ccuggcaggggaggcuuguuu

SEQ ID NO: 6796 - RNA, 21 nt, Artificial Sequence
  Guide Sequence
cggaggccccaaacaagccuc

SEQ ID NO: 6797 - RNA, 21 nt, Artificial Sequence
  Guide Sequence
cggucccuggcaggggaggcu

SEQ ID NO: 6798 - RNA, 21 nt, Artificial Sequence
  Guide Sequence
cuccccugccagggaccggca

SEQ ID NO: 6799 - RNA, 21 nt, Artificial Sequence
  Guide Sequence
cuggcaggcgaggcuuguuug

SEQ ID NO: 6800 - RNA, 21 nt, Artificial Sequence
  Guide Sequence
cuggcaggggaggcuuguuug

SEQ ID NO: 6801 - RNA, 21 nt, Artificial Sequence
  Guide Sequence
gaggccccaaacaagccuccc

SEQ ID NO: 6802 - RNA, 21 nt, Artificial Sequence
  Guide Sequence
gaggccccaaacaagccucgc

SEQ ID NO: 6803 - RNA, 21 nt, Artificial Sequence
  Guide Sequence
gcaggcgaggcuuguuugggg

SEQ ID NO: 6804 - RNA, 21 nt, Artificial Sequence
  Guide Sequence
gcaggggaggcuuguuugggg

SEQ ID NO: 6805 - RNA, 21 nt, Artificial Sequence
  Guide Sequence
gccccaaacaagccuccccug

SEQ ID NO: 6806 - RNA, 21 nt, Artificial Sequence
  Guide Sequence
gccccaaacaagccucgccug

SEQ ID NO: 6807 - RNA, 21 nt, Artificial Sequence
  Guide Sequence
gcgaggcuuguuuggggccuc

SEQ ID NO: 6808 - RNA, 21 nt, Artificial Sequence
  Guide Sequence
ggaggccccaaacaagccucc

SEQ ID NO: 6809 - RNA, 21 nt, Artificial Sequence
  Guide Sequence
ggaggccccaaacaagccucg

SEQ ID NO: 6810 - RNA, 21 nt, Artificial Sequence
  Guide Sequence
ggcaggcgaggcuuguuuggg

SEQ ID NO: 6811 - RNA, 21 nt, Artificial Sequence
  Guide Sequence
ggcaggggaggcuuguuuggg

SEQ ID NO: 6812 - RNA, 21 nt, Artificial Sequence
  Guide Sequence
ggccccaaacaagccuccccu

SEQ ID NO: 6813 - RNA, 21 nt, Artificial Sequence
  Guide Sequence
ggccccaaacaagccucgccu

SEQ ID NO: 6814 - RNA, 21 nt, Artificial Sequence
  Guide Sequence
ggcgaggcuuguuuggggccu

SEQ ID NO: 6815 - RNA, 21 nt, Artificial Sequence
  Guide Sequence
gggaggcuuguuuggggccuc

SEQ ID NO: 6816 - RNA, 21 nt, Artificial Sequence
  Guide Sequence
ggggaggcuuguuuggggccu

SEQ ID NO: 6817 - RNA, 21 nt, Artificial Sequence
  Guide Sequence
ggucccuggcaggggaggcuu

SEQ ID NO: 6818 - RNA, 21 nt, Artificial Sequence
  Guide Sequence
gucccuggcaggggaggcuug

SEQ ID NO: 6819 - RNA, 21 nt, Artificial Sequence
  Guide Sequence
guuugccggucccuggcaggg

SEQ ID NO: 6820 - RNA, 21 nt, Artificial Sequence
  Guide Sequence
uccccugccagggaccggcaa

SEQ ID NO: 6821 - RNA, 21 nt, Artificial Sequence
  Guide Sequence
ucccuggcaggcgaggcuugu

SEQ ID NO: 6822 - RNA, 21 nt, Artificial Sequence
  Guide Sequence
ucccuggcaggggaggcuugu

SEQ ID NO: 6823 - RNA, 21 nt, Artificial Sequence
  Guide Sequence
ugccggucccuggcaggggag

SEQ ID NO: 6824 - RNA, 21 nt, Artificial Sequence
  Guide Sequence
uggcaggcgaggcuuguuugg

SEQ ID NO: 6825 - RNA, 21 nt, Artificial Sequence
  Guide Sequence
uggcaggggaggcuuguuugg

SEQ ID NO: 6826 - RNA, 21 nt, Artificial Sequence
  Guide Sequence
uugccggucccuggcagggga

SEQ ID NO: 6827 - RNA, 21 nt, Artificial Sequence
  Guide Sequence
uuugccggucccuggcagggg

SEQ ID NO: 6828 - RNA, 22 nt, Artificial Sequence
  Guide Sequence
aaacaagccuccccugccaggg

SEQ ID NO: 6829 - RNA, 22 nt, Artificial Sequence
  Guide Sequence
aacaagccuccccugccaggga

SEQ ID NO: 6830 - RNA, 22 nt, Artificial Sequence
  Guide Sequence
aagccuccccugccagggaccg

SEQ ID NO: 6831 - RNA, 22 nt, Artificial Sequence
  Guide Sequence
acaagccuccccugccagggac

SEQ ID NO: 6832 - RNA, 22 nt, Artificial Sequence
  Guide Sequence
acggaggccccaaacaagccuc

SEQ ID NO: 6833 - RNA, 22 nt, Artificial Sequence
  Guide Sequence
agccuccccugccagggaccgg

SEQ ID NO: 6834 - RNA, 22 nt, Artificial Sequence
  Guide Sequence
aggccccaaacaagccuccccu

SEQ ID NO: 6835 - RNA, 22 nt, Artificial Sequence
  Guide Sequence
aggccccaaacaagccucgccu

SEQ ID NO: 6836 - RNA, 22 nt, Artificial Sequence
  Guide Sequence
aggcgaggcuuguuuggggccu

SEQ ID NO: 6837 - RNA, 22 nt, Artificial Sequence
  Guide Sequence
aggggaggcuuguuuggggccu

SEQ ID NO: 6838 - RNA, 22 nt, Artificial Sequence
  Guide Sequence
caaacaagccuccccugccagg

SEQ ID NO: 6839 - RNA, 22 nt, Artificial Sequence
  Guide Sequence
caagccuccccugccagggacc

SEQ ID NO: 6840 - RNA, 22 nt, Artificial Sequence
  Guide Sequence
cacggaggccccaaacaagccu

SEQ ID NO: 6841 - RNA, 22 nt, Artificial Sequence
  Guide Sequence
caggcgaggcuuguuuggggcc

SEQ ID NO: 6842 - RNA, 22 nt, Artificial Sequence
  Guide Sequence
caggggaggcuuguuuggggcc

SEQ ID NO: 6843 - RNA, 22 nt, Artificial Sequence
  Guide Sequence
ccaaacaagccuccccugccag

SEQ ID NO: 6844 - RNA, 22 nt, Artificial Sequence
  Guide Sequence
ccacggaggccccaaacaagcc

SEQ ID NO: 6845 - RNA, 22 nt, Artificial Sequence
  Guide Sequence
cccaaacaagccuccccugcca

SEQ ID NO: 6846 - RNA, 22 nt, Artificial Sequence
  Guide Sequence
ccccaaacaagccuccccugcc

SEQ ID NO: 6847 - RNA, 22 nt, Artificial Sequence
  Guide Sequence
ccccugccagggaccggcaaac

SEQ ID NO: 6848 - RNA, 22 nt, Artificial Sequence
  Guide Sequence
cccuggcaggcgaggcuuguuu

SEQ ID NO: 6849 - RNA, 22 nt, Artificial Sequence
  Guide Sequence
cccuggcaggggaggcuuguuu

SEQ ID NO: 6850 - RNA, 22 nt, Artificial Sequence
  Guide Sequence
ccggucccuggcaggggaggcu

SEQ ID NO: 6851 - RNA, 22 nt, Artificial Sequence
  Guide Sequence
ccuccccugccagggaccggca

SEQ ID NO: 6852 - RNA, 22 nt, Artificial Sequence
  Guide Sequence
ccuggcaggcgaggcuuguuug

SEQ ID NO: 6853 - RNA, 22 nt, Artificial Sequence
  Guide Sequence
ccuggcaggggaggcuuguuug

SEQ ID NO: 6854 - RNA, 22 nt, Artificial Sequence
  Guide Sequence
cggaggccccaaacaagccucc

SEQ ID NO: 6855 - RNA, 22 nt, Artificial Sequence
  Guide Sequence
cggaggccccaaacaagccucg

SEQ ID NO: 6856 - RNA, 22 nt, Artificial Sequence
  Guide Sequence
cggucccuggcaggggaggcuu

SEQ ID NO: 6857 - RNA, 22 nt, Artificial Sequence
  Guide Sequence
cuccccugccagggaccggcaa

SEQ ID NO: 6858 - RNA, 22 nt, Artificial Sequence
  Guide Sequence
cuggcaggcgaggcuuguuugg

SEQ ID NO: 6859 - RNA, 22 nt, Artificial Sequence
  Guide Sequence
cuggcaggggaggcuuguuugg

SEQ ID NO: 6860 - RNA, 22 nt, Artificial Sequence
  Guide Sequence
gaggccccaaacaagccucccc

SEQ ID NO: 6861 - RNA, 22 nt, Artificial Sequence
  Guide Sequence
gaggccccaaacaagccucgcc

SEQ ID NO: 6862 - RNA, 22 nt, Artificial Sequence
  Guide Sequence
gcaggcgaggcuuguuuggggc

SEQ ID NO: 6863 - RNA, 22 nt, Artificial Sequence
  Guide Sequence
gcaggggaggcuuguuuggggc

SEQ ID NO: 6864 - RNA, 22 nt, Artificial Sequence
  Guide Sequence
gccacggaggccccaaacaagc

SEQ ID NO: 6865 - RNA, 22 nt, Artificial Sequence
  Guide Sequence
gccccaaacaagccuccccugc

SEQ ID NO: 6866 - RNA, 22 nt, Artificial Sequence
  Guide Sequence
gccccaaacaagccucgccugc

SEQ ID NO: 6867 - RNA, 22 nt, Artificial Sequence
  Guide Sequence
gcgaggcuuguuuggggccucc

SEQ ID NO: 6868 - RNA, 22 nt, Artificial Sequence
  Guide Sequence
ggaggccccaaacaagccuccc

SEQ ID NO: 6869 - RNA, 22 nt, Artificial Sequence
  Guide Sequence
ggaggccccaaacaagccucgc

SEQ ID NO: 6870 - RNA, 22 nt, Artificial Sequence
  Guide Sequence
ggcaggcgaggcuuguuugggg

SEQ ID NO: 6871 - RNA, 22 nt, Artificial Sequence
  Guide Sequence
ggcaggggaggcuuguuugggg

SEQ ID NO: 6872 - RNA, 22 nt, Artificial Sequence
  Guide Sequence
ggccccaaacaagccuccccug

SEQ ID NO: 6873 - RNA, 22 nt, Artificial Sequence
  Guide Sequence
ggccccaaacaagccucgccug

SEQ ID NO: 6874 - RNA, 22 nt, Artificial Sequence
  Guide Sequence
ggcgaggcuuguuuggggccuc

SEQ ID NO: 6875 - RNA, 22 nt, Artificial Sequence
  Guide Sequence
gggaggcuuguuuggggccucc

SEQ ID NO: 6876 - RNA, 22 nt, Artificial Sequence
  Guide Sequence
ggggaggcuuguuuggggccuc

SEQ ID NO: 6877 - RNA, 22 nt, Artificial Sequence
  Guide Sequence
ggucccuggcaggggaggcuug

SEQ ID NO: 6878 - RNA, 22 nt, Artificial Sequence
  Guide Sequence
gucccuggcaggggaggcuugu

SEQ ID NO: 6879 - RNA, 22 nt, Artificial Sequence
  Guide Sequence
guuugccggucccuggcagggg

SEQ ID NO: 6880 - RNA, 22 nt, Artificial Sequence
  Guide Sequence
uccccugccagggaccggcaaa

SEQ ID NO: 6881 - RNA, 22 nt, Artificial Sequence
  Guide Sequence
ucccuggcaggcgaggcuuguu

SEQ ID NO: 6882 - RNA, 22 nt, Artificial Sequence
  Guide Sequence
ucccuggcaggggaggcuuguu

SEQ ID NO: 6883 - RNA, 22 nt, Artificial Sequence
  Guide Sequence
ugccggucccuggcaggggagg

SEQ ID NO: 6884 - RNA, 22 nt, Artificial Sequence
  Guide Sequence
uggcaggcgaggcuuguuuggg

SEQ ID NO: 6885 - RNA, 22 nt, Artificial Sequence
  Guide Sequence
uggcaggggaggcuuguuuggg

SEQ ID NO: 6886 - RNA, 22 nt, Artificial Sequence
  Guide Sequence
uguuugccggucccuggcaggg

SEQ ID NO: 6887 - RNA, 22 nt, Artificial Sequence
  Guide Sequence
uugccggucccuggcaggggag

SEQ ID NO: 6888 - RNA, 22 nt, Artificial Sequence
  Guide Sequence
uuugccggucccuggcagggga

SEQ ID NO: 6889 - RNA, 20 nt, Artificial Sequence
  Guide Sequence
aaaaagccaccugccgccag

SEQ ID NO: 6890 - RNA, 20 nt, Artificial Sequence
  Guide Sequence
aaaagccaccugccgccagc

SEQ ID NO: 6891 - RNA, 20 nt, Artificial Sequence
  Guide Sequence
aagaagccaccugccgccag

SEQ ID NO: 6892 - RNA, 20 nt, Artificial Sequence
  Guide Sequence
acuuggcuggcggcaggugg

SEQ ID NO: 6893 - RNA, 20 nt, Artificial Sequence
  Guide Sequence
agaagccaccugccgccagc

SEQ ID NO: 6894 - RNA, 20 nt, Artificial Sequence
  Guide Sequence
agccaggcuucucaaaaagc

SEQ ID NO: 6895 - RNA, 20 nt, Artificial Sequence
  Guide Sequence
agccaggcuucucaagaagc

SEQ ID NO: 6896 - RNA, 20 nt, Artificial Sequence
  Guide Sequence
aggcuucucaaaaagccacc

SEQ ID NO: 6897 - RNA, 20 nt, Artificial Sequence
  Guide Sequence
aggcuucucaagaagccacc

SEQ ID NO: 6898 - RNA, 20 nt, Artificial Sequence
  Guide Sequence
agguggcuucuugagaagcc

SEQ ID NO: 6899 - RNA, 20 nt, Artificial Sequence
  Guide Sequence
agguggcuuuuugagaagcc

SEQ ID NO: 6900 - RNA, 20 nt, Artificial Sequence
  Guide Sequence
caaaaagccaccugccgcca

SEQ ID NO: 6901 - RNA, 20 nt, Artificial Sequence
  Guide Sequence
caagaagccaccugccgcca

SEQ ID NO: 6902 - RNA, 20 nt, Artificial Sequence
  Guide Sequence
caggcuucucaaaaagccac

SEQ ID NO: 6903 - RNA, 20 nt, Artificial Sequence
  Guide Sequence
caggcuucucaagaagccac

SEQ ID NO: 6904 - RNA, 20 nt, Artificial Sequence
  Guide Sequence
cagguggcuucuugagaagc

SEQ ID NO: 6905 - RNA, 20 nt, Artificial Sequence
  Guide Sequence
cagguggcuuuuugagaagc

SEQ ID NO: 6906 - RNA, 20 nt, Artificial Sequence
  Guide Sequence
ccaggcuucucaaaaagcca

SEQ ID NO: 6907 - RNA, 20 nt, Artificial Sequence
  Guide Sequence
ccaggcuucucaagaagcca

SEQ ID NO: 6908 - RNA, 20 nt, Artificial Sequence
  Guide Sequence
cggcagguggcuucuugaga

SEQ ID NO: 6909 - RNA, 20 nt, Artificial Sequence
  Guide Sequence
cggcagguggcuuuuugaga

SEQ ID NO: 6910 - RNA, 20 nt, Artificial Sequence
  Guide Sequence
cucaaaaagccaccugccgc

SEQ ID NO: 6911 - RNA, 20 nt, Artificial Sequence
  Guide Sequence
cucaagaagccaccugccgc

SEQ ID NO: 6912 - RNA, 20 nt, Artificial Sequence
  Guide Sequence
cuggcggcagguggcuucuu

SEQ ID NO: 6913 - RNA, 20 nt, Artificial Sequence
  Guide Sequence
cuggcggcagguggcuuuuu

SEQ ID NO: 6914 - RNA, 20 nt, Artificial Sequence
  Guide Sequence
cugugagccaggcuucucaa

SEQ ID NO: 6915 - RNA, 20 nt, Artificial Sequence
  Guide Sequence
cuucucaaaaagccaccugc

SEQ ID NO: 6916 - RNA, 20 nt, Artificial Sequence
  Guide Sequence
cuucucaagaagccaccugc

SEQ ID NO: 6917 - RNA, 20 nt, Artificial Sequence
  Guide Sequence
cuucuugagaagccuggcuc

SEQ ID NO: 6918 - RNA, 20 nt, Artificial Sequence
  Guide Sequence
cuuggcuggcggcagguggc

SEQ ID NO: 6919 - RNA, 20 nt, Artificial Sequence
  Guide Sequence
cuuuuugagaagccuggcuc

SEQ ID NO: 6920 - RNA, 20 nt, Artificial Sequence
  Guide Sequence
gagccaggcuucucaaaaag

SEQ ID NO: 6921 - RNA, 20 nt, Artificial Sequence
  Guide Sequence
gagccaggcuucucaagaag

SEQ ID NO: 6922 - RNA, 20 nt, Artificial Sequence
  Guide Sequence
gcagguggcuucuugagaag

SEQ ID NO: 6923 - RNA, 20 nt, Artificial Sequence
  Guide Sequence
gcagguggcuuuuugagaag

SEQ ID NO: 6924 - RNA, 20 nt, Artificial Sequence
  Guide Sequence
gccaggcuucucaaaaagcc

SEQ ID NO: 6925 - RNA, 20 nt, Artificial Sequence
  Guide Sequence
gccaggcuucucaagaagcc

SEQ ID NO: 6926 - RNA, 20 nt, Artificial Sequence
  Guide Sequence
gcggcagguggcuucuugag

SEQ ID NO: 6927 - RNA, 20 nt, Artificial Sequence
  Guide Sequence
gcggcagguggcuuuuugag

SEQ ID NO: 6928 - RNA, 20 nt, Artificial Sequence
  Guide Sequence
gcuggcggcagguggcuucu

SEQ ID NO: 6929 - RNA, 20 nt, Artificial Sequence
  Guide Sequence
gcuggcggcagguggcuuuu

SEQ ID NO: 6930 - RNA, 20 nt, Artificial Sequence
  Guide Sequence
gcugugagccaggcuucuca

SEQ ID NO: 6931 - RNA, 20 nt, Artificial Sequence
  Guide Sequence
gcuucucaaaaagccaccug

SEQ ID NO: 6932 - RNA, 20 nt, Artificial Sequence
  Guide Sequence
gcuucucaagaagccaccug

SEQ ID NO: 6933 - RNA, 20 nt, Artificial Sequence
  Guide Sequence
gcuucuugagaagccuggcu

SEQ ID NO: 6934 - RNA, 20 nt, Artificial Sequence
  Guide Sequence
gcuuuuugagaagccuggcu

SEQ ID NO: 6935 - RNA, 20 nt, Artificial Sequence
  Guide Sequence
ggcagguggcuucuugagaa

SEQ ID NO: 6936 - RNA, 20 nt, Artificial Sequence
  Guide Sequence
ggcagguggcuuuuugagaa

SEQ ID NO: 6937 - RNA, 20 nt, Artificial Sequence
  Guide Sequence
ggcggcagguggcuucuuga

SEQ ID NO: 6938 - RNA, 20 nt, Artificial Sequence
  Guide Sequence
ggcggcagguggcuuuuuga

SEQ ID NO: 6939 - RNA, 20 nt, Artificial Sequence
  Guide Sequence
ggcuggcggcagguggcuuc

SEQ ID NO: 6940 - RNA, 20 nt, Artificial Sequence
  Guide Sequence
ggcuggcggcagguggcuuu

SEQ ID NO: 6941 - RNA, 20 nt, Artificial Sequence
  Guide Sequence
ggcugugagccaggcuucuc

SEQ ID NO: 6942 - RNA, 20 nt, Artificial Sequence
  Guide Sequence
ggcuucucaaaaagccaccu

SEQ ID NO: 6943 - RNA, 20 nt, Artificial Sequence
  Guide Sequence
ggcuucucaagaagccaccu

SEQ ID NO: 6944 - RNA, 20 nt, Artificial Sequence
  Guide Sequence
ggcuucuugagaagccuggc

SEQ ID NO: 6945 - RNA, 20 nt, Artificial Sequence
  Guide Sequence
ggcuuuuugagaagccuggc

SEQ ID NO: 6946 - RNA, 20 nt, Artificial Sequence
  Guide Sequence
gguggcuucuugagaagccu

SEQ ID NO: 6947 - RNA, 20 nt, Artificial Sequence
  Guide Sequence
gguggcuuuuugagaagccu

SEQ ID NO: 6948 - RNA, 20 nt, Artificial Sequence
  Guide Sequence
gugagccaggcuucucaaaa

SEQ ID NO: 6949 - RNA, 20 nt, Artificial Sequence
  Guide Sequence
gugagccaggcuucucaaga

SEQ ID NO: 6950 - RNA, 20 nt, Artificial Sequence
  Guide Sequence
guggcuucuugagaagccug

SEQ ID NO: 6951 - RNA, 20 nt, Artificial Sequence
  Guide Sequence
guggcuuuuugagaagccug

SEQ ID NO: 6952 - RNA, 20 nt, Artificial Sequence
  Guide Sequence
ucaaaaagccaccugccgcc

SEQ ID NO: 6953 - RNA, 20 nt, Artificial Sequence
  Guide Sequence
ucaagaagccaccugccgcc

SEQ ID NO: 6954 - RNA, 20 nt, Artificial Sequence
  Guide Sequence
ucucaaaaagccaccugccg

SEQ ID NO: 6955 - RNA, 20 nt, Artificial Sequence
  Guide Sequence
ucucaagaagccaccugccg

SEQ ID NO: 6956 - RNA, 20 nt, Artificial Sequence
  Guide Sequence
ucuugagaagccuggcucac

SEQ ID NO: 6957 - RNA, 20 nt, Artificial Sequence
  Guide Sequence
ugagccaggcuucucaaaaa

SEQ ID NO: 6958 - RNA, 20 nt, Artificial Sequence
  Guide Sequence
ugagccaggcuucucaagaa

SEQ ID NO: 6959 - RNA, 20 nt, Artificial Sequence
  Guide Sequence
uggcggcagguggcuucuug

SEQ ID NO: 6960 - RNA, 20 nt, Artificial Sequence
  Guide Sequence
uggcggcagguggcuuuuug

SEQ ID NO: 6961 - RNA, 20 nt, Artificial Sequence
  Guide Sequence
uggcuggcggcagguggcuu

SEQ ID NO: 6962 - RNA, 20 nt, Artificial Sequence
  Guide Sequence
uggcugugagccaggcuucu

SEQ ID NO: 6963 - RNA, 20 nt, Artificial Sequence
  Guide Sequence
uggcuucuugagaagccugg

SEQ ID NO: 6964 - RNA, 20 nt, Artificial Sequence
  Guide Sequence
uggcuuuuugagaagccugg

SEQ ID NO: 6965 - RNA, 20 nt, Artificial Sequence
  Guide Sequence
ugugagccaggcuucucaaa

SEQ ID NO: 6966 - RNA, 20 nt, Artificial Sequence
  Guide Sequence
ugugagccaggcuucucaag

SEQ ID NO: 6967 - RNA, 20 nt, Artificial Sequence
  Guide Sequence
uucucaaaaagccaccugcc

SEQ ID NO: 6968 - RNA, 20 nt, Artificial Sequence
  Guide Sequence
uucucaagaagccaccugcc

SEQ ID NO: 6969 - RNA, 20 nt, Artificial Sequence
  Guide Sequence
uucuugagaagccuggcuca

SEQ ID NO: 6970 - RNA, 20 nt, Artificial Sequence
  Guide Sequence
uuggcuggcggcagguggcu

SEQ ID NO: 6971 - RNA, 20 nt, Artificial Sequence
  Guide Sequence
uuuugagaagccuggcucac

SEQ ID NO: 6972 - RNA, 20 nt, Artificial Sequence
  Guide Sequence
uuuuugagaagccuggcuca

SEQ ID NO: 6973 - RNA, 21 nt, Artificial Sequence
  Guide Sequence
aaaaagccaccugccgccagc

SEQ ID NO: 6974 - RNA, 21 nt, Artificial Sequence
  Guide Sequence
aaaagccaccugccgccagcc

SEQ ID NO: 6975 - RNA, 21 nt, Artificial Sequence
  Guide Sequence
aagaagccaccugccgccagc

SEQ ID NO: 6976 - RNA, 21 nt, Artificial Sequence
  Guide Sequence
acuuggcuggcggcagguggc

SEQ ID NO: 6977 - RNA, 21 nt, Artificial Sequence
  Guide Sequence
agaagccaccugccgccagcc

SEQ ID NO: 6978 - RNA, 21 nt, Artificial Sequence
  Guide Sequence
agccaggcuucucaaaaagcc

SEQ ID NO: 6979 - RNA, 21 nt, Artificial Sequence
  Guide Sequence
agccaggcuucucaagaagcc

SEQ ID NO: 6980 - RNA, 21 nt, Artificial Sequence
  Guide Sequence
aggcuucucaaaaagccaccu

SEQ ID NO: 6981 - RNA, 21 nt, Artificial Sequence
  Guide Sequence
aggcuucucaagaagccaccu

SEQ ID NO: 6982 - RNA, 21 nt, Artificial Sequence
  Guide Sequence
agguggcuucuugagaagccu

SEQ ID NO: 6983 - RNA, 21 nt, Artificial Sequence
  Guide Sequence
agguggcuuuuugagaagccu

SEQ ID NO: 6984 - RNA, 21 nt, Artificial Sequence
  Guide Sequence
caaaaagccaccugccgccag

SEQ ID NO: 6985 - RNA, 21 nt, Artificial Sequence
  Guide Sequence
caagaagccaccugccgccag

SEQ ID NO: 6986 - RNA, 21 nt, Artificial Sequence
  Guide Sequence
caggcuucucaaaaagccacc

SEQ ID NO: 6987 - RNA, 21 nt, Artificial Sequence
  Guide Sequence
caggcuucucaagaagccacc

SEQ ID NO: 6988 - RNA, 21 nt, Artificial Sequence
  Guide Sequence
cagguggcuucuugagaagcc

SEQ ID NO: 6989 - RNA, 21 nt, Artificial Sequence
  Guide Sequence
cagguggcuuuuugagaagcc

SEQ ID NO: 6990 - RNA, 21 nt, Artificial Sequence
  Guide Sequence
ccaggcuucucaaaaagccac

SEQ ID NO: 6991 - RNA, 21 nt, Artificial Sequence
  Guide Sequence
ccaggcuucucaagaagccac

SEQ ID NO: 6992 - RNA, 21 nt, Artificial Sequence
  Guide Sequence
cggcagguggcuucuugagaa

SEQ ID NO: 6993 - RNA, 21 nt, Artificial Sequence
  Guide Sequence
cggcagguggcuuuuugagaa

SEQ ID NO: 6994 - RNA, 21 nt, Artificial Sequence
  Guide Sequence
cucaaaaagccaccugccgcc

SEQ ID NO: 6995 - RNA, 21 nt, Artificial Sequence
  Guide Sequence
cucaagaagccaccugccgcc

SEQ ID NO: 6996 - RNA, 21 nt, Artificial Sequence
  Guide Sequence
cuggcggcagguggcuucuug

SEQ ID NO: 6997 - RNA, 21 nt, Artificial Sequence
  Guide Sequence
cuggcggcagguggcuuuuug

SEQ ID NO: 6998 - RNA, 21 nt, Artificial Sequence
  Guide Sequence
cuggcugugagccaggcuucu

SEQ ID NO: 6999 - RNA, 21 nt, Artificial Sequence
  Guide Sequence
cugugagccaggcuucucaaa

SEQ ID NO: 7000 - RNA, 21 nt, Artificial Sequence
  Guide Sequence
cugugagccaggcuucucaag

SEQ ID NO: 7001 - RNA, 21 nt, Artificial Sequence
  Guide Sequence
cuucucaaaaagccaccugcc

SEQ ID NO: 7002 - RNA, 21 nt, Artificial Sequence
  Guide Sequence
cuucucaagaagccaccugcc

SEQ ID NO: 7003 - RNA, 21 nt, Artificial Sequence
  Guide Sequence
cuucuugagaagccuggcuca

SEQ ID NO: 7004 - RNA, 21 nt, Artificial Sequence
  Guide Sequence
cuuggcuggcggcagguggcu

SEQ ID NO: 7005 - RNA, 21 nt, Artificial Sequence
  Guide Sequence
cuuuuugagaagccuggcuca

SEQ ID NO: 7006 - RNA, 21 nt, Artificial Sequence
  Guide Sequence
gacuuggcuggcggcaggugg

SEQ ID NO: 7007 - RNA, 21 nt, Artificial Sequence
  Guide Sequence
gagccaggcuucucaaaaagc

SEQ ID NO: 7008 - RNA, 21 nt, Artificial Sequence
  Guide Sequence
gagccaggcuucucaagaagc

SEQ ID NO: 7009 - RNA, 21 nt, Artificial Sequence
  Guide Sequence
gcagguggcuucuugagaagc

SEQ ID NO: 7010 - RNA, 21 nt, Artificial Sequence
  Guide Sequence
gcagguggcuuuuugagaagc

SEQ ID NO: 7011 - RNA, 21 nt, Artificial Sequence
  Guide Sequence
gccaggcuucucaaaaagcca

SEQ ID NO: 7012 - RNA, 21 nt, Artificial Sequence
  Guide Sequence
gccaggcuucucaagaagcca

SEQ ID NO: 7013 - RNA, 21 nt, Artificial Sequence
  Guide Sequence
gcggcagguggcuucuugaga

SEQ ID NO: 7014 - RNA, 21 nt, Artificial Sequence
  Guide Sequence
gcggcagguggcuuuuugaga

SEQ ID NO: 7015 - RNA, 21 nt, Artificial Sequence
  Guide Sequence
gcuggcggcagguggcuucuu

SEQ ID NO: 7016 - RNA, 21 nt, Artificial Sequence
  Guide Sequence
gcuggcggcagguggcuuuuu

SEQ ID NO: 7017 - RNA, 21 nt, Artificial Sequence
  Guide Sequence
gcugugagccaggcuucucaa

SEQ ID NO: 7018 - RNA, 21 nt, Artificial Sequence
  Guide Sequence
gcuucucaaaaagccaccugc

SEQ ID NO: 7019 - RNA, 21 nt, Artificial Sequence
  Guide Sequence
gcuucucaagaagccaccugc

SEQ ID NO: 7020 - RNA, 21 nt, Artificial Sequence
  Guide Sequence
gcuucuugagaagccuggcuc

SEQ ID NO: 7021 - RNA, 21 nt, Artificial Sequence
  Guide Sequence
gcuuuuugagaagccuggcuc

SEQ ID NO: 7022 - RNA, 21 nt, Artificial Sequence
  Guide Sequence
ggcagguggcuucuugagaag

SEQ ID NO: 7023 - RNA, 21 nt, Artificial Sequence
  Guide Sequence
ggcagguggcuuuuugagaag

SEQ ID NO: 7024 - RNA, 21 nt, Artificial Sequence
  Guide Sequence
ggcggcagguggcuucuugag

SEQ ID NO: 7025 - RNA, 21 nt, Artificial Sequence
  Guide Sequence
ggcggcagguggcuuuuugag

SEQ ID NO: 7026 - RNA, 21 nt, Artificial Sequence
  Guide Sequence
ggcuggcggcagguggcuucu

SEQ ID NO: 7027 - RNA, 21 nt, Artificial Sequence
  Guide Sequence
ggcuggcggcagguggcuuuu

SEQ ID NO: 7028 - RNA, 21 nt, Artificial Sequence
  Guide Sequence
ggcugugagccaggcuucuca

SEQ ID NO: 7029 - RNA, 21 nt, Artificial Sequence
  Guide Sequence
ggcuucucaaaaagccaccug

SEQ ID NO: 7030 - RNA, 21 nt, Artificial Sequence
  Guide Sequence
ggcuucucaagaagccaccug

SEQ ID NO: 7031 - RNA, 21 nt, Artificial Sequence
  Guide Sequence
ggcuucuugagaagccuggcu

SEQ ID NO: 7032 - RNA, 21 nt, Artificial Sequence
  Guide Sequence
ggcuuuuugagaagccuggcu

SEQ ID NO: 7033 - RNA, 21 nt, Artificial Sequence
  Guide Sequence
gguggcuucuugagaagccug

SEQ ID NO: 7034 - RNA, 21 nt, Artificial Sequence
  Guide Sequence
gguggcuuuuugagaagccug

SEQ ID NO: 7035 - RNA, 21 nt, Artificial Sequence
  Guide Sequence
gugagccaggcuucucaaaaa

SEQ ID NO: 7036 - RNA, 21 nt, Artificial Sequence
  Guide Sequence
gugagccaggcuucucaagaa

SEQ ID NO: 7037 - RNA, 21 nt, Artificial Sequence
  Guide Sequence
guggcuucuugagaagccugg

SEQ ID NO: 7038 - RNA, 21 nt, Artificial Sequence
  Guide Sequence
guggcuuuuugagaagccugg

SEQ ID NO: 7039 - RNA, 21 nt, Artificial Sequence
  Guide Sequence
ucaaaaagccaccugccgcca

SEQ ID NO: 7040 - RNA, 21 nt, Artificial Sequence
  Guide Sequence
ucaagaagccaccugccgcca

SEQ ID NO: 7041 - RNA, 21 nt, Artificial Sequence
  Guide Sequence
ucucaaaaagccaccugccgc

SEQ ID NO: 7042 - RNA, 21 nt, Artificial Sequence
  Guide Sequence
ucucaagaagccaccugccgc

SEQ ID NO: 7043 - RNA, 21 nt, Artificial Sequence
  Guide Sequence
ucuugagaagccuggcucaca

SEQ ID NO: 7044 - RNA, 21 nt, Artificial Sequence
  Guide Sequence
ugagccaggcuucucaaaaag

SEQ ID NO: 7045 - RNA, 21 nt, Artificial Sequence
  Guide Sequence
ugagccaggcuucucaagaag

SEQ ID NO: 7046 - RNA, 21 nt, Artificial Sequence
  Guide Sequence
uggcggcagguggcuucuuga

SEQ ID NO: 7047 - RNA, 21 nt, Artificial Sequence
  Guide Sequence
uggcggcagguggcuuuuuga

SEQ ID NO: 7048 - RNA, 21 nt, Artificial Sequence
  Guide Sequence
uggcuggcggcagguggcuuc

SEQ ID NO: 7049 - RNA, 21 nt, Artificial Sequence
  Guide Sequence
uggcuggcggcagguggcuuu

SEQ ID NO: 7050 - RNA, 21 nt, Artificial Sequence
  Guide Sequence
uggcugugagccaggcuucuc

SEQ ID NO: 7051 - RNA, 21 nt, Artificial Sequence
  Guide Sequence
uggcuucuugagaagccuggc

SEQ ID NO: 7052 - RNA, 21 nt, Artificial Sequence
  Guide Sequence
uggcuuuuugagaagccuggc

SEQ ID NO: 7053 - RNA, 21 nt, Artificial Sequence
  Guide Sequence
ugugagccaggcuucucaaaa

SEQ ID NO: 7054 - RNA, 21 nt, Artificial Sequence
  Guide Sequence
ugugagccaggcuucucaaga

SEQ ID NO: 7055 - RNA, 21 nt, Artificial Sequence
  Guide Sequence
uucucaaaaagccaccugccg

SEQ ID NO: 7056 - RNA, 21 nt, Artificial Sequence
  Guide Sequence
uucucaagaagccaccugccg

SEQ ID NO: 7057 - RNA, 21 nt, Artificial Sequence
  Guide Sequence
uucuugagaagccuggcucac

SEQ ID NO: 7058 - RNA, 21 nt, Artificial Sequence
  Guide Sequence
uuggcuggcggcagguggcuu

SEQ ID NO: 7059 - RNA, 21 nt, Artificial Sequence
  Guide Sequence
uuuugagaagccuggcucaca

SEQ ID NO: 7060 - RNA, 21 nt, Artificial Sequence
  Guide Sequence
uuuuugagaagccuggcucac

SEQ ID NO: 7061 - RNA, 22 nt, Artificial Sequence
  Guide Sequence
aaaaagccaccugccgccagcc

SEQ ID NO: 7062 - RNA, 22 nt, Artificial Sequence
  Guide Sequence
aaaagccaccugccgccagcca

SEQ ID NO: 7063 - RNA, 22 nt, Artificial Sequence
  Guide Sequence
aagaagccaccugccgccagcc

SEQ ID NO: 7064 - RNA, 22 nt, Artificial Sequence
  Guide Sequence
acuuggcuggcggcagguggcu

SEQ ID NO: 7065 - RNA, 22 nt, Artificial Sequence
  Guide Sequence
agaagccaccugccgccagcca

SEQ ID NO: 7066 - RNA, 22 nt, Artificial Sequence
  Guide Sequence
agccaggcuucucaaaaagcca

SEQ ID NO: 7067 - RNA, 22 nt, Artificial Sequence
  Guide Sequence
agccaggcuucucaagaagcca

SEQ ID NO: 7068 - RNA, 22 nt, Artificial Sequence
  Guide Sequence
aggcuucucaaaaagccaccug

SEQ ID NO: 7069 - RNA, 22 nt, Artificial Sequence
  Guide Sequence
aggcuucucaagaagccaccug

SEQ ID NO: 7070 - RNA, 22 nt, Artificial Sequence
  Guide Sequence
agguggcuucuugagaagccug

SEQ ID NO: 7071 - RNA, 22 nt, Artificial Sequence
  Guide Sequence
agguggcuuuuugagaagccug

SEQ ID NO: 7072 - RNA, 22 nt, Artificial Sequence
  Guide Sequence
caaaaagccaccugccgccagc

SEQ ID NO: 7073 - RNA, 22 nt, Artificial Sequence
  Guide Sequence
caagaagccaccugccgccagc

SEQ ID NO: 7074 - RNA, 22 nt, Artificial Sequence
  Guide Sequence
caggcuucucaaaaagccaccu

SEQ ID NO: 7075 - RNA, 22 nt, Artificial Sequence
  Guide Sequence
caggcuucucaagaagccaccu

SEQ ID NO: 7076 - RNA, 22 nt, Artificial Sequence
  Guide Sequence
cagguggcuucuugagaagccu

SEQ ID NO: 7077 - RNA, 22 nt, Artificial Sequence
  Guide Sequence
cagguggcuuuuugagaagccu

SEQ ID NO: 7078 - RNA, 22 nt, Artificial Sequence
  Guide Sequence
ccaggcuucucaaaaagccacc

SEQ ID NO: 7079 - RNA, 22 nt, Artificial Sequence
  Guide Sequence
ccaggcuucucaagaagccacc

SEQ ID NO: 7080 - RNA, 22 nt, Artificial Sequence
  Guide Sequence
ccuggcugugagccaggcuucu

SEQ ID NO: 7081 - RNA, 22 nt, Artificial Sequence
  Guide Sequence
cggcagguggcuucuugagaag

SEQ ID NO: 7082 - RNA, 22 nt, Artificial Sequence
  Guide Sequence
cggcagguggcuuuuugagaag

SEQ ID NO: 7083 - RNA, 22 nt, Artificial Sequence
  Guide Sequence
cucaaaaagccaccugccgcca

SEQ ID NO: 7084 - RNA, 22 nt, Artificial Sequence
  Guide Sequence
cucaagaagccaccugccgcca

SEQ ID NO: 7085 - RNA, 22 nt, Artificial Sequence
  Guide Sequence
cuggcggcagguggcuucuuga

SEQ ID NO: 7086 - RNA, 22 nt, Artificial Sequence
  Guide Sequence
cuggcggcagguggcuuuuuga

SEQ ID NO: 7087 - RNA, 22 nt, Artificial Sequence
  Guide Sequence
cuggcugugagccaggcuucuc

SEQ ID NO: 7088 - RNA, 22 nt, Artificial Sequence
  Guide Sequence
cugugagccaggcuucucaaaa

SEQ ID NO: 7089 - RNA, 22 nt, Artificial Sequence
  Guide Sequence
cugugagccaggcuucucaaga

SEQ ID NO: 7090 - RNA, 22 nt, Artificial Sequence
  Guide Sequence
cuucucaaaaagccaccugccg

SEQ ID NO: 7091 - RNA, 22 nt, Artificial Sequence
  Guide Sequence
cuucucaagaagccaccugccg

SEQ ID NO: 7092 - RNA, 22 nt, Artificial Sequence
  Guide Sequence
cuucuugagaagccuggcucac

SEQ ID NO: 7093 - RNA, 22 nt, Artificial Sequence
  Guide Sequence
cuuggcuggcggcagguggcuu

SEQ ID NO: 7094 - RNA, 22 nt, Artificial Sequence
  Guide Sequence
cuuuuugagaagccuggcucac

SEQ ID NO: 7095 - RNA, 22 nt, Artificial Sequence
  Guide Sequence
gacuuggcuggcggcagguggc

SEQ ID NO: 7096 - RNA, 22 nt, Artificial Sequence
  Guide Sequence
gagccaggcuucucaaaaagcc

SEQ ID NO: 7097 - RNA, 22 nt, Artificial Sequence
  Guide Sequence
gagccaggcuucucaagaagcc

SEQ ID NO: 7098 - RNA, 22 nt, Artificial Sequence
  Guide Sequence
gcagguggcuucuugagaagcc

SEQ ID NO: 7099 - RNA, 22 nt, Artificial Sequence
  Guide Sequence
gcagguggcuuuuugagaagcc

SEQ ID NO: 7100 - RNA, 22 nt, Artificial Sequence
  Guide Sequence
gccaggcuucucaaaaagccac

SEQ ID NO: 7101 - RNA, 22 nt, Artificial Sequence
  Guide Sequence
gccaggcuucucaagaagccac

SEQ ID NO: 7102 - RNA, 22 nt, Artificial Sequence
  Guide Sequence
gcggcagguggcuucuugagaa

SEQ ID NO: 7103 - RNA, 22 nt, Artificial Sequence
  Guide Sequence
gcggcagguggcuuuuugagaa

SEQ ID NO: 7104 - RNA, 22 nt, Artificial Sequence
  Guide Sequence
gcuggcggcagguggcuucuug

SEQ ID NO: 7105 - RNA, 22 nt, Artificial Sequence
  Guide Sequence
gcuggcggcagguggcuuuuug

SEQ ID NO: 7106 - RNA, 22 nt, Artificial Sequence
  Guide Sequence
gcugugagccaggcuucucaaa

SEQ ID NO: 7107 - RNA, 22 nt, Artificial Sequence
  Guide Sequence
gcugugagccaggcuucucaag

SEQ ID NO: 7108 - RNA, 22 nt, Artificial Sequence
  Guide Sequence
gcuucucaaaaagccaccugcc

SEQ ID NO: 7109 - RNA, 22 nt, Artificial Sequence
  Guide Sequence
gcuucucaagaagccaccugcc

SEQ ID NO: 7110 - RNA, 22 nt, Artificial Sequence
  Guide Sequence
gcuucuugagaagccuggcuca

SEQ ID NO: 7111 - RNA, 22 nt, Artificial Sequence
  Guide Sequence
gcuuuuugagaagccuggcuca

SEQ ID NO: 7112 - RNA, 22 nt, Artificial Sequence
  Guide Sequence
ggacuuggcuggcggcaggugg

SEQ ID NO: 7113 - RNA, 22 nt, Artificial Sequence
  Guide Sequence
ggcagguggcuucuugagaagc

SEQ ID NO: 7114 - RNA, 22 nt, Artificial Sequence
  Guide Sequence
ggcagguggcuuuuugagaagc

SEQ ID NO: 7115 - RNA, 22 nt, Artificial Sequence
  Guide Sequence
ggcggcagguggcuucuugaga

SEQ ID NO: 7116 - RNA, 22 nt, Artificial Sequence
  Guide Sequence
ggcggcagguggcuuuuugaga

SEQ ID NO: 7117 - RNA, 22 nt, Artificial Sequence
  Guide Sequence
ggcuggcggcagguggcuucuu

SEQ ID NO: 7118 - RNA, 22 nt, Artificial Sequence
  Guide Sequence
ggcuggcggcagguggcuuuuu

SEQ ID NO: 7119 - RNA, 22 nt, Artificial Sequence
  Guide Sequence
ggcugugagccaggcuucucaa

SEQ ID NO: 7120 - RNA, 22 nt, Artificial Sequence
  Guide Sequence
ggcuucucaaaaagccaccugc

SEQ ID NO: 7121 - RNA, 22 nt, Artificial Sequence
  Guide Sequence
ggcuucucaagaagccaccugc

SEQ ID NO: 7122 - RNA, 22 nt, Artificial Sequence
  Guide Sequence
ggcuucuugagaagccuggcuc

SEQ ID NO: 7123 - RNA, 22 nt, Artificial Sequence
  Guide Sequence
ggcuuuuugagaagccuggcuc

SEQ ID NO: 7124 - RNA, 22 nt, Artificial Sequence
  Guide Sequence
gguggcuucuugagaagccugg

SEQ ID NO: 7125 - RNA, 22 nt, Artificial Sequence
  Guide Sequence
gguggcuuuuugagaagccugg

SEQ ID NO: 7126 - RNA, 22 nt, Artificial Sequence
  Guide Sequence
gugagccaggcuucucaaaaag

SEQ ID NO: 7127 - RNA, 22 nt, Artificial Sequence
  Guide Sequence
gugagccaggcuucucaagaag

SEQ ID NO: 7128 - RNA, 22 nt, Artificial Sequence
  Guide Sequence
guggcuucuugagaagccuggc

SEQ ID NO: 7129 - RNA, 22 nt, Artificial Sequence
  Guide Sequence
guggcuuuuugagaagccuggc

SEQ ID NO: 7130 - RNA, 22 nt, Artificial Sequence
  Guide Sequence
ucaaaaagccaccugccgccag

SEQ ID NO: 7131 - RNA, 22 nt, Artificial Sequence
  Guide Sequence
ucaagaagccaccugccgccag

SEQ ID NO: 7132 - RNA, 22 nt, Artificial Sequence
  Guide Sequence
ucucaaaaagccaccugccgcc

SEQ ID NO: 7133 - RNA, 22 nt, Artificial Sequence
  Guide Sequence
ucucaagaagccaccugccgcc

SEQ ID NO: 7134 - RNA, 22 nt, Artificial Sequence
  Guide Sequence
ucuugagaagccuggcucacag

SEQ ID NO: 7135 - RNA, 22 nt, Artificial Sequence
  Guide Sequence
ugagccaggcuucucaaaaagc

SEQ ID NO: 7136 - RNA, 22 nt, Artificial Sequence
  Guide Sequence
ugagccaggcuucucaagaagc

SEQ ID NO: 7137 - RNA, 22 nt, Artificial Sequence
  Guide Sequence
uggcggcagguggcuucuugag

SEQ ID NO: 7138 - RNA, 22 nt, Artificial Sequence
  Guide Sequence
uggcggcagguggcuuuuugag

SEQ ID NO: 7139 - RNA, 22 nt, Artificial Sequence
  Guide Sequence
uggcuggcggcagguggcuucu

SEQ ID NO: 7140 - RNA, 22 nt, Artificial Sequence
  Guide Sequence
uggcuggcggcagguggcuuuu

SEQ ID NO: 7141 - RNA, 22 nt, Artificial Sequence
  Guide Sequence
uggcugugagccaggcuucuca

SEQ ID NO: 7142 - RNA, 22 nt, Artificial Sequence
  Guide Sequence
uggcuucuugagaagccuggcu

SEQ ID NO: 7143 - RNA, 22 nt, Artificial Sequence
  Guide Sequence
uggcuuuuugagaagccuggcu

SEQ ID NO: 7144 - RNA, 22 nt, Artificial Sequence
  Guide Sequence
ugugagccaggcuucucaaaaa

SEQ ID NO: 7145 - RNA, 22 nt, Artificial Sequence
  Guide Sequence
ugugagccaggcuucucaagaa

SEQ ID NO: 7146 - RNA, 22 nt, Artificial Sequence
  Guide Sequence
uucucaaaaagccaccugccgc

SEQ ID NO: 7147 - RNA, 22 nt, Artificial Sequence
  Guide Sequence
uucucaagaagccaccugccgc

SEQ ID NO: 7148 - RNA, 22 nt, Artificial Sequence
  Guide Sequence
uucuugagaagccuggcucaca

SEQ ID NO: 7149 - RNA, 22 nt, Artificial Sequence
  Guide Sequence
uuggcuggcggcagguggcuuc

SEQ ID NO: 7150 - RNA, 22 nt, Artificial Sequence
  Guide Sequence
uuggcuggcggcagguggcuuu

SEQ ID NO: 7151 - RNA, 22 nt, Artificial Sequence
  Guide Sequence
uuuugagaagccuggcucacag

SEQ ID NO: 7152 - RNA, 22 nt, Artificial Sequence
  Guide Sequence
uuuuugagaagccuggcucaca

SEQ ID NO: 7153 - RNA, 20 nt, Artificial Sequence
  Guide Sequence
aaacugagucucaagggagu

SEQ ID NO: 7154 - RNA, 20 nt, Artificial Sequence
  Guide Sequence
aaacugggucucaagggagu

SEQ ID NO: 7155 - RNA, 20 nt, Artificial Sequence
  Guide Sequence
aacugagucucaagggagug

SEQ ID NO: 7156 - RNA, 20 nt, Artificial Sequence
  Guide Sequence
aacugggucucaagggagug

SEQ ID NO: 7157 - RNA, 20 nt, Artificial Sequence
  Guide Sequence
acagacguggaaacugaguc

SEQ ID NO: 7158 - RNA, 20 nt, Artificial Sequence
  Guide Sequence
acagacguggaaacuggguc

SEQ ID NO: 7159 - RNA, 20 nt, Artificial Sequence
  Guide Sequence
acccaguuuccacgucugug

SEQ ID NO: 7160 - RNA, 20 nt, Artificial Sequence
  Guide Sequence
acguggaaacugagucucaa

SEQ ID NO: 7161 - RNA, 20 nt, Artificial Sequence
  Guide Sequence
acguggaaacugggucucaa

SEQ ID NO: 7162 - RNA, 20 nt, Artificial Sequence
  Guide Sequence
acucaguuuccacgucugug

SEQ ID NO: 7163 - RNA, 20 nt, Artificial Sequence
  Guide Sequence
acucccuugagacccaguuu

SEQ ID NO: 7164 - RNA, 20 nt, Artificial Sequence
  Guide Sequence
acucccuugagacucaguuu

SEQ ID NO: 7165 - RNA, 20 nt, Artificial Sequence
  Guide Sequence
acugagucucaagggagugg

SEQ ID NO: 7166 - RNA, 20 nt, Artificial Sequence
  Guide Sequence
acugggucucaagggagugg

SEQ ID NO: 7167 - RNA, 20 nt, Artificial Sequence
  Guide Sequence
agacccaguuuccacgucug

SEQ ID NO: 7168 - RNA, 20 nt, Artificial Sequence
  Guide Sequence
agacguggaaacugagucuc

SEQ ID NO: 7169 - RNA, 20 nt, Artificial Sequence
  Guide Sequence
agacguggaaacugggucuc

SEQ ID NO: 7170 - RNA, 20 nt, Artificial Sequence
  Guide Sequence
agacucaguuuccacgucug

SEQ ID NO: 7171 - RNA, 20 nt, Artificial Sequence
  Guide Sequence
auuucacagacguggaaacu

SEQ ID NO: 7172 - RNA, 20 nt, Artificial Sequence
  Guide Sequence
cacagacguggaaacugagu

SEQ ID NO: 7173 - RNA, 20 nt, Artificial Sequence
  Guide Sequence
cacagacguggaaacugggu

SEQ ID NO: 7174 - RNA, 20 nt, Artificial Sequence
  Guide Sequence
cacucccuugagacccaguu

SEQ ID NO: 7175 - RNA, 20 nt, Artificial Sequence
  Guide Sequence
cacucccuugagacucaguu

SEQ ID NO: 7176 - RNA, 20 nt, Artificial Sequence
  Guide Sequence
cagacguggaaacugagucu

SEQ ID NO: 7177 - RNA, 20 nt, Artificial Sequence
  Guide Sequence
cagacguggaaacugggucu

SEQ ID NO: 7178 - RNA, 20 nt, Artificial Sequence
  Guide Sequence
cauuucacagacguggaaac

SEQ ID NO: 7179 - RNA, 20 nt, Artificial Sequence
  Guide Sequence
ccacucccuugagacccagu

SEQ ID NO: 7180 - RNA, 20 nt, Artificial Sequence
  Guide Sequence
ccacucccuugagacucagu

SEQ ID NO: 7181 - RNA, 20 nt, Artificial Sequence
  Guide Sequence
ccauuucacagacguggaaa

SEQ ID NO: 7182 - RNA, 20 nt, Artificial Sequence
  Guide Sequence
cccaguuuccacgucuguga

SEQ ID NO: 7183 - RNA, 20 nt, Artificial Sequence
  Guide Sequence
cccuugagacccaguuucca

SEQ ID NO: 7184 - RNA, 20 nt, Artificial Sequence
  Guide Sequence
cccuugagacucaguuucca

SEQ ID NO: 7185 - RNA, 20 nt, Artificial Sequence
  Guide Sequence
ccuggccacucccuugagac

SEQ ID NO: 7186 - RNA, 20 nt, Artificial Sequence
  Guide Sequence
ccuugagacccaguuuccac

SEQ ID NO: 7187 - RNA, 20 nt, Artificial Sequence
  Guide Sequence
ccuugagacucaguuuccac

SEQ ID NO: 7188 - RNA, 20 nt, Artificial Sequence
  Guide Sequence
cguggaaacugagucucaag

SEQ ID NO: 7189 - RNA, 20 nt, Artificial Sequence
  Guide Sequence
cguggaaacugggucucaag

SEQ ID NO: 7190 - RNA, 20 nt, Artificial Sequence
  Guide Sequence
cucaguuuccacgucuguga

SEQ ID NO: 7191 - RNA, 20 nt, Artificial Sequence
  Guide Sequence
cucccuugagacccaguuuc

SEQ ID NO: 7192 - RNA, 20 nt, Artificial Sequence
  Guide Sequence
cucccuugagacucaguuuc

SEQ ID NO: 7193 - RNA, 20 nt, Artificial Sequence
  Guide Sequence
cugagucucaagggaguggc

SEQ ID NO: 7194 - RNA, 20 nt, Artificial Sequence
  Guide Sequence
cuggccacucccuugagacc

SEQ ID NO: 7195 - RNA, 20 nt, Artificial Sequence
  Guide Sequence
cuggccacucccuugagacu

SEQ ID NO: 7196 - RNA, 20 nt, Artificial Sequence
  Guide Sequence
cugggucucaagggaguggc

SEQ ID NO: 7197 - RNA, 20 nt, Artificial Sequence
  Guide Sequence
cuugagacccaguuuccacg

SEQ ID NO: 7198 - RNA, 20 nt, Artificial Sequence
  Guide Sequence
cuugagacucaguuuccacg

SEQ ID NO: 7199 - RNA, 20 nt, Artificial Sequence
  Guide Sequence
gaaacugagucucaagggag

SEQ ID NO: 7200 - RNA, 20 nt, Artificial Sequence
  Guide Sequence
gaaacugggucucaagggag

SEQ ID NO: 7201 - RNA, 20 nt, Artificial Sequence
  Guide Sequence
gacccaguuuccacgucugu

SEQ ID NO: 7202 - RNA, 20 nt, Artificial Sequence
  Guide Sequence
gacguggaaacugagucuca

SEQ ID NO: 7203 - RNA, 20 nt, Artificial Sequence
  Guide Sequence
gacguggaaacugggucuca

SEQ ID NO: 7204 - RNA, 20 nt, Artificial Sequence
  Guide Sequence
gacucaguuuccacgucugu

SEQ ID NO: 7205 - RNA, 20 nt, Artificial Sequence
  Guide Sequence
gagacccaguuuccacgucu

SEQ ID NO: 7206 - RNA, 20 nt, Artificial Sequence
  Guide Sequence
gagacucaguuuccacgucu

SEQ ID NO: 7207 - RNA, 20 nt, Artificial Sequence
  Guide Sequence
gagucucaagggaguggcca

SEQ ID NO: 7208 - RNA, 20 nt, Artificial Sequence
  Guide Sequence
gccacucccuugagacccag

SEQ ID NO: 7209 - RNA, 20 nt, Artificial Sequence
  Guide Sequence
gccacucccuugagacucag

SEQ ID NO: 7210 - RNA, 20 nt, Artificial Sequence
  Guide Sequence
gccuggccacucccuugaga

SEQ ID NO: 7211 - RNA, 20 nt, Artificial Sequence
  Guide Sequence
ggaaacugagucucaaggga

SEQ ID NO: 7212 - RNA, 20 nt, Artificial Sequence
  Guide Sequence
ggaaacugggucucaaggga

SEQ ID NO: 7213 - RNA, 20 nt, Artificial Sequence
  Guide Sequence
ggccacucccuugagaccca

SEQ ID NO: 7214 - RNA, 20 nt, Artificial Sequence
  Guide Sequence
ggccacucccuugagacuca

SEQ ID NO: 7215 - RNA, 20 nt, Artificial Sequence
  Guide Sequence
gggucucaagggaguggcca

SEQ ID NO: 7216 - RNA, 20 nt, Artificial Sequence
  Guide Sequence
gugccuggccacucccuuga

SEQ ID NO: 7217 - RNA, 20 nt, Artificial Sequence
  Guide Sequence
guggaaacugagucucaagg

SEQ ID NO: 7218 - RNA, 20 nt, Artificial Sequence
  Guide Sequence
guggaaacugggucucaagg

SEQ ID NO: 7219 - RNA, 20 nt, Artificial Sequence
  Guide Sequence
ucacagacguggaaacugag

SEQ ID NO: 7220 - RNA, 20 nt, Artificial Sequence
  Guide Sequence
ucacagacguggaaacuggg

SEQ ID NO: 7221 - RNA, 20 nt, Artificial Sequence
  Guide Sequence
ucccuugagacccaguuucc

SEQ ID NO: 7222 - RNA, 20 nt, Artificial Sequence
  Guide Sequence
ucccuugagacucaguuucc

SEQ ID NO: 7223 - RNA, 20 nt, Artificial Sequence
  Guide Sequence
ugagacccaguuuccacguc

SEQ ID NO: 7224 - RNA, 20 nt, Artificial Sequence
  Guide Sequence
ugagacucaguuuccacguc

SEQ ID NO: 7225 - RNA, 20 nt, Artificial Sequence
  Guide Sequence
ugagucucaagggaguggcc

SEQ ID NO: 7226 - RNA, 20 nt, Artificial Sequence
  Guide Sequence
ugccuggccacucccuugag

SEQ ID NO: 7227 - RNA, 20 nt, Artificial Sequence
  Guide Sequence
uggaaacugagucucaaggg

SEQ ID NO: 7228 - RNA, 20 nt, Artificial Sequence
  Guide Sequence
uggaaacugggucucaaggg

SEQ ID NO: 7229 - RNA, 20 nt, Artificial Sequence
  Guide Sequence
uggccacucccuugagaccc

SEQ ID NO: 7230 - RNA, 20 nt, Artificial Sequence
  Guide Sequence
uggccacucccuugagacuc

SEQ ID NO: 7231 - RNA, 20 nt, Artificial Sequence
  Guide Sequence
ugggucucaagggaguggcc

SEQ ID NO: 7232 - RNA, 20 nt, Artificial Sequence
  Guide Sequence
uucacagacguggaaacuga

SEQ ID NO: 7233 - RNA, 20 nt, Artificial Sequence
  Guide Sequence
uucacagacguggaaacugg

SEQ ID NO: 7234 - RNA, 20 nt, Artificial Sequence
  Guide Sequence
uugagacccaguuuccacgu

SEQ ID NO: 7235 - RNA, 20 nt, Artificial Sequence
  Guide Sequence
uugagacucaguuuccacgu

SEQ ID NO: 7236 - RNA, 20 nt, Artificial Sequence
  Guide Sequence
uuucacagacguggaaacug

SEQ ID NO: 7237 - RNA, 21 nt, Artificial Sequence
  Guide Sequence
aaacugagucucaagggagug

SEQ ID NO: 7238 - RNA, 21 nt, Artificial Sequence
  Guide Sequence
aaacugggucucaagggagug

SEQ ID NO: 7239 - RNA, 21 nt, Artificial Sequence
  Guide Sequence
aacugagucucaagggagugg

SEQ ID NO: 7240 - RNA, 21 nt, Artificial Sequence
  Guide Sequence
aacugggucucaagggagugg

SEQ ID NO: 7241 - RNA, 21 nt, Artificial Sequence
  Guide Sequence
acagacguggaaacugagucu

SEQ ID NO: 7242 - RNA, 21 nt, Artificial Sequence
  Guide Sequence
acagacguggaaacugggucu

SEQ ID NO: 7243 - RNA, 21 nt, Artificial Sequence
  Guide Sequence
acccaguuuccacgucuguga

SEQ ID NO: 7244 - RNA, 21 nt, Artificial Sequence
  Guide Sequence
acguggaaacugagucucaag

SEQ ID NO: 7245 - RNA, 21 nt, Artificial Sequence
  Guide Sequence
acguggaaacugggucucaag

SEQ ID NO: 7246 - RNA, 21 nt, Artificial Sequence
  Guide Sequence
acucaguuuccacgucuguga

SEQ ID NO: 7247 - RNA, 21 nt, Artificial Sequence
  Guide Sequence
acucccuugagacccaguuuc

SEQ ID NO: 7248 - RNA, 21 nt, Artificial Sequence
  Guide Sequence
acucccuugagacucaguuuc

SEQ ID NO: 7249 - RNA, 21 nt, Artificial Sequence
  Guide Sequence
acugagucucaagggaguggc

SEQ ID NO: 7250 - RNA, 21 nt, Artificial Sequence
  Guide Sequence
acugggucucaagggaguggc

SEQ ID NO: 7251 - RNA, 21 nt, Artificial Sequence
  Guide Sequence
agacccaguuuccacgucugu

SEQ ID NO: 7252 - RNA, 21 nt, Artificial Sequence
  Guide Sequence
agacguggaaacugagucuca

SEQ ID NO: 7253 - RNA, 21 nt, Artificial Sequence
  Guide Sequence
agacguggaaacugggucuca

SEQ ID NO: 7254 - RNA, 21 nt, Artificial Sequence
  Guide Sequence
agacucaguuuccacgucugu

SEQ ID NO: 7255 - RNA, 21 nt, Artificial Sequence
  Guide Sequence
auuucacagacguggaaacug

SEQ ID NO: 7256 - RNA, 21 nt, Artificial Sequence
  Guide Sequence
cacagacguggaaacugaguc

SEQ ID NO: 7257 - RNA, 21 nt, Artificial Sequence
  Guide Sequence
cacagacguggaaacuggguc

SEQ ID NO: 7258 - RNA, 21 nt, Artificial Sequence
  Guide Sequence
cacucccuugagacccaguuu

SEQ ID NO: 7259 - RNA, 21 nt, Artificial Sequence
  Guide Sequence
cacucccuugagacucaguuu

SEQ ID NO: 7260 - RNA, 21 nt, Artificial Sequence
  Guide Sequence
cagacguggaaacugagucuc

SEQ ID NO: 7261 - RNA, 21 nt, Artificial Sequence
  Guide Sequence
cagacguggaaacugggucuc

SEQ ID NO: 7262 - RNA, 21 nt, Artificial Sequence
  Guide Sequence
cauuucacagacguggaaacu

SEQ ID NO: 7263 - RNA, 21 nt, Artificial Sequence
  Guide Sequence
ccacucccuugagacccaguu

SEQ ID NO: 7264 - RNA, 21 nt, Artificial Sequence
  Guide Sequence
ccacucccuugagacucaguu

SEQ ID NO: 7265 - RNA, 21 nt, Artificial Sequence
  Guide Sequence
ccauuucacagacguggaaac

SEQ ID NO: 7266 - RNA, 21 nt, Artificial Sequence
  Guide Sequence
cccaguuuccacgucugugaa

SEQ ID NO: 7267 - RNA, 21 nt, Artificial Sequence
  Guide Sequence
cccauuucacagacguggaaa

SEQ ID NO: 7268 - RNA, 21 nt, Artificial Sequence
  Guide Sequence
cccuugagacccaguuuccac

SEQ ID NO: 7269 - RNA, 21 nt, Artificial Sequence
  Guide Sequence
cccuugagacucaguuuccac

SEQ ID NO: 7270 - RNA, 21 nt, Artificial Sequence
  Guide Sequence
ccuggccacucccuugagacc

SEQ ID NO: 7271 - RNA, 21 nt, Artificial Sequence
  Guide Sequence
ccuggccacucccuugagacu

SEQ ID NO: 7272 - RNA, 21 nt, Artificial Sequence
  Guide Sequence
ccuugagacccaguuuccacg

SEQ ID NO: 7273 - RNA, 21 nt, Artificial Sequence
  Guide Sequence
ccuugagacucaguuuccacg

SEQ ID NO: 7274 - RNA, 21 nt, Artificial Sequence
  Guide Sequence
cguggaaacugagucucaagg

SEQ ID NO: 7275 - RNA, 21 nt, Artificial Sequence
  Guide Sequence
cguggaaacugggucucaagg

SEQ ID NO: 7276 - RNA, 21 nt, Artificial Sequence
  Guide Sequence
cucaguuuccacgucugugaa

SEQ ID NO: 7277 - RNA, 21 nt, Artificial Sequence
  Guide Sequence
cucccuugagacccaguuucc

SEQ ID NO: 7278 - RNA, 21 nt, Artificial Sequence
  Guide Sequence
cucccuugagacucaguuucc

SEQ ID NO: 7279 - RNA, 21 nt, Artificial Sequence
  Guide Sequence
cugagucucaagggaguggcc

SEQ ID NO: 7280 - RNA, 21 nt, Artificial Sequence
  Guide Sequence
cuggccacucccuugagaccc

SEQ ID NO: 7281 - RNA, 21 nt, Artificial Sequence
  Guide Sequence
cuggccacucccuugagacuc

SEQ ID NO: 7282 - RNA, 21 nt, Artificial Sequence
  Guide Sequence
cugggucucaagggaguggcc

SEQ ID NO: 7283 - RNA, 21 nt, Artificial Sequence
  Guide Sequence
cuugagacccaguuuccacgu

SEQ ID NO: 7284 - RNA, 21 nt, Artificial Sequence
  Guide Sequence
cuugagacucaguuuccacgu

SEQ ID NO: 7285 - RNA, 21 nt, Artificial Sequence
  Guide Sequence
gaaacugagucucaagggagu

SEQ ID NO: 7286 - RNA, 21 nt, Artificial Sequence
  Guide Sequence
gaaacugggucucaagggagu

SEQ ID NO: 7287 - RNA, 21 nt, Artificial Sequence
  Guide Sequence
gacccaguuuccacgucugug

SEQ ID NO: 7288 - RNA, 21 nt, Artificial Sequence
  Guide Sequence
gacguggaaacugagucucaa

SEQ ID NO: 7289 - RNA, 21 nt, Artificial Sequence
  Guide Sequence
gacguggaaacugggucucaa

SEQ ID NO: 7290 - RNA, 21 nt, Artificial Sequence
  Guide Sequence
gacucaguuuccacgucugug

SEQ ID NO: 7291 - RNA, 21 nt, Artificial Sequence
  Guide Sequence
gagacccaguuuccacgucug

SEQ ID NO: 7292 - RNA, 21 nt, Artificial Sequence
  Guide Sequence
gagacucaguuuccacgucug

SEQ ID NO: 7293 - RNA, 21 nt, Artificial Sequence
  Guide Sequence
gagucucaagggaguggccag

SEQ ID NO: 7294 - RNA, 21 nt, Artificial Sequence
  Guide Sequence
gccacucccuugagacccagu

SEQ ID NO: 7295 - RNA, 21 nt, Artificial Sequence
  Guide Sequence
gccacucccuugagacucagu

SEQ ID NO: 7296 - RNA, 21 nt, Artificial Sequence
  Guide Sequence
gccuggccacucccuugagac

SEQ ID NO: 7297 - RNA, 21 nt, Artificial Sequence
  Guide Sequence
ggaaacugagucucaagggag

SEQ ID NO: 7298 - RNA, 21 nt, Artificial Sequence
  Guide Sequence
ggaaacugggucucaagggag

SEQ ID NO: 7299 - RNA, 21 nt, Artificial Sequence
  Guide Sequence
ggccacucccuugagacccag

SEQ ID NO: 7300 - RNA, 21 nt, Artificial Sequence
  Guide Sequence
ggccacucccuugagacucag

SEQ ID NO: 7301 - RNA, 21 nt, Artificial Sequence
  Guide Sequence
gggucucaagggaguggccag

SEQ ID NO: 7302 - RNA, 21 nt, Artificial Sequence
  Guide Sequence
gugccuggccacucccuugag

SEQ ID NO: 7303 - RNA, 21 nt, Artificial Sequence
  Guide Sequence
guggaaacugagucucaaggg

SEQ ID NO: 7304 - RNA, 21 nt, Artificial Sequence
  Guide Sequence
guggaaacugggucucaaggg

SEQ ID NO: 7305 - RNA, 21 nt, Artificial Sequence
  Guide Sequence
ucacagacguggaaacugagu

SEQ ID NO: 7306 - RNA, 21 nt, Artificial Sequence
  Guide Sequence
ucacagacguggaaacugggu

SEQ ID NO: 7307 - RNA, 21 nt, Artificial Sequence
  Guide Sequence
ucccuugagacccaguuucca

SEQ ID NO: 7308 - RNA, 21 nt, Artificial Sequence
  Guide Sequence
ucccuugagacucaguuucca

SEQ ID NO: 7309 - RNA, 21 nt, Artificial Sequence
  Guide Sequence
ugagacccaguuuccacgucu

SEQ ID NO: 7310 - RNA, 21 nt, Artificial Sequence
  Guide Sequence
ugagacucaguuuccacgucu

SEQ ID NO: 7311 - RNA, 21 nt, Artificial Sequence
  Guide Sequence
ugagucucaagggaguggcca

SEQ ID NO: 7312 - RNA, 21 nt, Artificial Sequence
  Guide Sequence
ugccuggccacucccuugaga

SEQ ID NO: 7313 - RNA, 21 nt, Artificial Sequence
  Guide Sequence
uggaaacugagucucaaggga

SEQ ID NO: 7314 - RNA, 21 nt, Artificial Sequence
  Guide Sequence
uggaaacugggucucaaggga

SEQ ID NO: 7315 - RNA, 21 nt, Artificial Sequence
  Guide Sequence
uggccacucccuugagaccca

SEQ ID NO: 7316 - RNA, 21 nt, Artificial Sequence
  Guide Sequence
uggccacucccuugagacuca

SEQ ID NO: 7317 - RNA, 21 nt, Artificial Sequence
  Guide Sequence
ugggucucaagggaguggcca

SEQ ID NO: 7318 - RNA, 21 nt, Artificial Sequence
  Guide Sequence
ugugccuggccacucccuuga

SEQ ID NO: 7319 - RNA, 21 nt, Artificial Sequence
  Guide Sequence
uucacagacguggaaacugag

SEQ ID NO: 7320 - RNA, 21 nt, Artificial Sequence
  Guide Sequence
uucacagacguggaaacuggg

SEQ ID NO: 7321 - RNA, 21 nt, Artificial Sequence
  Guide Sequence
uugagacccaguuuccacguc

SEQ ID NO: 7322 - RNA, 21 nt, Artificial Sequence
  Guide Sequence
uugagacucaguuuccacguc

SEQ ID NO: 7323 - RNA, 21 nt, Artificial Sequence
  Guide Sequence
uuucacagacguggaaacuga

SEQ ID NO: 7324 - RNA, 21 nt, Artificial Sequence
  Guide Sequence
uuucacagacguggaaacugg

SEQ ID NO: 7325 - RNA, 22 nt, Artificial Sequence
  Guide Sequence
aaacugagucucaagggagugg

SEQ ID NO: 7326 - RNA, 22 nt, Artificial Sequence
  Guide Sequence
aaacugggucucaagggagugg

SEQ ID NO: 7327 - RNA, 22 nt, Artificial Sequence
  Guide Sequence
aacugagucucaagggaguggc

SEQ ID NO: 7328 - RNA, 22 nt, Artificial Sequence
  Guide Sequence
aacugggucucaagggaguggc

SEQ ID NO: 7329 - RNA, 22 nt, Artificial Sequence
  Guide Sequence
acagacguggaaacugagucuc

SEQ ID NO: 7330 - RNA, 22 nt, Artificial Sequence
  Guide Sequence
acagacguggaaacugggucuc

SEQ ID NO: 7331 - RNA, 22 nt, Artificial Sequence
  Guide Sequence
acccaguuuccacgucugugaa

SEQ ID NO: 7332 - RNA, 22 nt, Artificial Sequence
  Guide Sequence
acguggaaacugagucucaagg

SEQ ID NO: 7333 - RNA, 22 nt, Artificial Sequence
  Guide Sequence
acguggaaacugggucucaagg

SEQ ID NO: 7334 - RNA, 22 nt, Artificial Sequence
  Guide Sequence
acucaguuuccacgucugugaa

SEQ ID NO: 7335 - RNA, 22 nt, Artificial Sequence
  Guide Sequence
acucccuugagacccaguuucc

SEQ ID NO: 7336 - RNA, 22 nt, Artificial Sequence
  Guide Sequence
acucccuugagacucaguuucc

SEQ ID NO: 7337 - RNA, 22 nt, Artificial Sequence
  Guide Sequence
acugagucucaagggaguggcc

SEQ ID NO: 7338 - RNA, 22 nt, Artificial Sequence
  Guide Sequence
acugggucucaagggaguggcc

SEQ ID NO: 7339 - RNA, 22 nt, Artificial Sequence
  Guide Sequence
agacccaguuuccacgucugug

SEQ ID NO: 7340 - RNA, 22 nt, Artificial Sequence
  Guide Sequence
agacguggaaacugagucucaa

SEQ ID NO: 7341 - RNA, 22 nt, Artificial Sequence
  Guide Sequence
agacguggaaacugggucucaa

SEQ ID NO: 7342 - RNA, 22 nt, Artificial Sequence
  Guide Sequence
agacucaguuuccacgucugug

SEQ ID NO: 7343 - RNA, 22 nt, Artificial Sequence
  Guide Sequence
auuucacagacguggaaacuga

SEQ ID NO: 7344 - RNA, 22 nt, Artificial Sequence
  Guide Sequence
auuucacagacguggaaacugg

SEQ ID NO: 7345 - RNA, 22 nt, Artificial Sequence
  Guide Sequence
cacagacguggaaacugagucu

SEQ ID NO: 7346 - RNA, 22 nt, Artificial Sequence
  Guide Sequence
cacagacguggaaacugggucu

SEQ ID NO: 7347 - RNA, 22 nt, Artificial Sequence
  Guide Sequence
cacucccuugagacccaguuuc

SEQ ID NO: 7348 - RNA, 22 nt, Artificial Sequence
  Guide Sequence
cacucccuugagacucaguuuc

SEQ ID NO: 7349 - RNA, 22 nt, Artificial Sequence
  Guide Sequence
cagacguggaaacugagucuca

SEQ ID NO: 7350 - RNA, 22 nt, Artificial Sequence
  Guide Sequence
cagacguggaaacugggucuca

SEQ ID NO: 7351 - RNA, 22 nt, Artificial Sequence
  Guide Sequence
cauuucacagacguggaaacug

SEQ ID NO: 7352 - RNA, 22 nt, Artificial Sequence
  Guide Sequence
ccacucccuugagacccaguuu

SEQ ID NO: 7353 - RNA, 22 nt, Artificial Sequence
  Guide Sequence
ccacucccuugagacucaguuu

SEQ ID NO: 7354 - RNA, 22 nt, Artificial Sequence
  Guide Sequence
ccauuucacagacguggaaacu

SEQ ID NO: 7355 - RNA, 22 nt, Artificial Sequence
  Guide Sequence
cccaguuuccacgucugugaaa

SEQ ID NO: 7356 - RNA, 22 nt, Artificial Sequence
  Guide Sequence
cccauuucacagacguggaaac

SEQ ID NO: 7357 - RNA, 22 nt, Artificial Sequence
  Guide Sequence
ccccauuucacagacguggaaa

SEQ ID NO: 7358 - RNA, 22 nt, Artificial Sequence
  Guide Sequence
cccuugagacccaguuuccacg

SEQ ID NO: 7359 - RNA, 22 nt, Artificial Sequence
  Guide Sequence
cccuugagacucaguuuccacg

SEQ ID NO: 7360 - RNA, 22 nt, Artificial Sequence
  Guide Sequence
ccuggccacucccuugagaccc

SEQ ID NO: 7361 - RNA, 22 nt, Artificial Sequence
  Guide Sequence
ccuggccacucccuugagacuc

SEQ ID NO: 7362 - RNA, 22 nt, Artificial Sequence
  Guide Sequence
ccuugagacccaguuuccacgu

SEQ ID NO: 7363 - RNA, 22 nt, Artificial Sequence
  Guide Sequence
ccuugagacucaguuuccacgu

SEQ ID NO: 7364 - RNA, 22 nt, Artificial Sequence
  Guide Sequence
cguggaaacugagucucaaggg

SEQ ID NO: 7365 - RNA, 22 nt, Artificial Sequence
  Guide Sequence
cguggaaacugggucucaaggg

SEQ ID NO: 7366 - RNA, 22 nt, Artificial Sequence
  Guide Sequence
cucaguuuccacgucugugaaa

SEQ ID NO: 7367 - RNA, 22 nt, Artificial Sequence
  Guide Sequence
cucccuugagacccaguuucca

SEQ ID NO: 7368 - RNA, 22 nt, Artificial Sequence
  Guide Sequence
cucccuugagacucaguuucca

SEQ ID NO: 7369 - RNA, 22 nt, Artificial Sequence
  Guide Sequence
cugagucucaagggaguggcca

SEQ ID NO: 7370 - RNA, 22 nt, Artificial Sequence
  Guide Sequence
cuggccacucccuugagaccca

SEQ ID NO: 7371 - RNA, 22 nt, Artificial Sequence
  Guide Sequence
cuggccacucccuugagacuca

SEQ ID NO: 7372 - RNA, 22 nt, Artificial Sequence
  Guide Sequence
cugggucucaagggaguggcca

SEQ ID NO: 7373 - RNA, 22 nt, Artificial Sequence
  Guide Sequence
cugugccuggccacucccuuga

SEQ ID NO: 7374 - RNA, 22 nt, Artificial Sequence
  Guide Sequence
cuugagacccaguuuccacguc

SEQ ID NO: 7375 - RNA, 22 nt, Artificial Sequence
  Guide Sequence
cuugagacucaguuuccacguc

SEQ ID NO: 7376 - RNA, 22 nt, Artificial Sequence
  Guide Sequence
gaaacugagucucaagggagug

SEQ ID NO: 7377 - RNA, 22 nt, Artificial Sequence
  Guide Sequence
gaaacugggucucaagggagug

SEQ ID NO: 7378 - RNA, 22 nt, Artificial Sequence
  Guide Sequence
gacccaguuuccacgucuguga

SEQ ID NO: 7379 - RNA, 22 nt, Artificial Sequence
  Guide Sequence
gacguggaaacugagucucaag

SEQ ID NO: 7380 - RNA, 22 nt, Artificial Sequence
  Guide Sequence
gacguggaaacugggucucaag

SEQ ID NO: 7381 - RNA, 22 nt, Artificial Sequence
  Guide Sequence
gacucaguuuccacgucuguga

SEQ ID NO: 7382 - RNA, 22 nt, Artificial Sequence
  Guide Sequence
gagacccaguuuccacgucugu

SEQ ID NO: 7383 - RNA, 22 nt, Artificial Sequence
  Guide Sequence
gagacucaguuuccacgucugu

SEQ ID NO: 7384 - RNA, 22 nt, Artificial Sequence
  Guide Sequence
gagucucaagggaguggccagg

SEQ ID NO: 7385 - RNA, 22 nt, Artificial Sequence
  Guide Sequence
gccacucccuugagacccaguu

SEQ ID NO: 7386 - RNA, 22 nt, Artificial Sequence
  Guide Sequence
gccacucccuugagacucaguu

SEQ ID NO: 7387 - RNA, 22 nt, Artificial Sequence
  Guide Sequence
gccuggccacucccuugagacc

SEQ ID NO: 7388 - RNA, 22 nt, Artificial Sequence
  Guide Sequence
gccuggccacucccuugagacu

SEQ ID NO: 7389 - RNA, 22 nt, Artificial Sequence
  Guide Sequence
ggaaacugagucucaagggagu

SEQ ID NO: 7390 - RNA, 22 nt, Artificial Sequence
  Guide Sequence
ggaaacugggucucaagggagu

SEQ ID NO: 7391 - RNA, 22 nt, Artificial Sequence
  Guide Sequence
ggccacucccuugagacccagu

SEQ ID NO: 7392 - RNA, 22 nt, Artificial Sequence
  Guide Sequence
ggccacucccuugagacucagu

SEQ ID NO: 7393 - RNA, 22 nt, Artificial Sequence
  Guide Sequence
gggucucaagggaguggccagg

SEQ ID NO: 7394 - RNA, 22 nt, Artificial Sequence
  Guide Sequence
gugccuggccacucccuugaga

SEQ ID NO: 7395 - RNA, 22 nt, Artificial Sequence
  Guide Sequence
guggaaacugagucucaaggga

SEQ ID NO: 7396 - RNA, 22 nt, Artificial Sequence
  Guide Sequence
guggaaacugggucucaaggga

SEQ ID NO: 7397 - RNA, 22 nt, Artificial Sequence
  Guide Sequence
ucacagacguggaaacugaguc

SEQ ID NO: 7398 - RNA, 22 nt, Artificial Sequence
  Guide Sequence
ucacagacguggaaacuggguc

SEQ ID NO: 7399 - RNA, 22 nt, Artificial Sequence
  Guide Sequence
ucccuugagacccaguuuccac

SEQ ID NO: 7400 - RNA, 22 nt, Artificial Sequence
  Guide Sequence
ucccuugagacucaguuuccac

SEQ ID NO: 7401 - RNA, 22 nt, Artificial Sequence
  Guide Sequence
ugagacccaguuuccacgucug

SEQ ID NO: 7402 - RNA, 22 nt, Artificial Sequence
  Guide Sequence
ugagacucaguuuccacgucug

SEQ ID NO: 7403 - RNA, 22 nt, Artificial Sequence
  Guide Sequence
ugagucucaagggaguggccag

SEQ ID NO: 7404 - RNA, 22 nt, Artificial Sequence
  Guide Sequence
ugccuggccacucccuugagac

SEQ ID NO: 7405 - RNA, 22 nt, Artificial Sequence
  Guide Sequence
uggaaacugagucucaagggag

SEQ ID NO: 7406 - RNA, 22 nt, Artificial Sequence
  Guide Sequence
uggaaacugggucucaagggag

SEQ ID NO: 7407 - RNA, 22 nt, Artificial Sequence
  Guide Sequence
uggccacucccuugagacccag

SEQ ID NO: 7408 - RNA, 22 nt, Artificial Sequence
  Guide Sequence
uggccacucccuugagacucag

SEQ ID NO: 7409 - RNA, 22 nt, Artificial Sequence
  Guide Sequence
ugggucucaagggaguggccag

SEQ ID NO: 7410 - RNA, 22 nt, Artificial Sequence
  Guide Sequence
ugugccuggccacucccuugag

SEQ ID NO: 7411 - RNA, 22 nt, Artificial Sequence
  Guide Sequence
uucacagacguggaaacugagu

SEQ ID NO: 7412 - RNA, 22 nt, Artificial Sequence
  Guide Sequence
uucacagacguggaaacugggu

SEQ ID NO: 7413 - RNA, 22 nt, Artificial Sequence
  Guide Sequence
uugagacccaguuuccacgucu

SEQ ID NO: 7414 - RNA, 22 nt, Artificial Sequence
  Guide Sequence
uugagacucaguuuccacgucu

SEQ ID NO: 7415 - RNA, 22 nt, Artificial Sequence
  Guide Sequence
uuucacagacguggaaacugag

SEQ ID NO: 7416 - RNA, 22 nt, Artificial Sequence
  Guide Sequence
uuucacagacguggaaacuggg

SEQ ID NO: 7417 - RNA, 20 nt, Artificial Sequence
  Guide Sequence
aaauguggcuaucaucuucc

SEQ ID NO: 7418 - RNA, 20 nt, Artificial Sequence
  Guide Sequence
aacaaccccuuuuccgggug

SEQ ID NO: 7419 - RNA, 20 nt, Artificial Sequence
  Guide Sequence
aaccccuuuuccggguggaa

SEQ ID NO: 7420 - RNA, 20 nt, Artificial Sequence
  Guide Sequence
aaccuaggggaagggcgagg

SEQ ID NO: 7421 - RNA, 20 nt, Artificial Sequence
  Guide Sequence
aacugugacagggaaccuag

SEQ ID NO: 7422 - RNA, 20 nt, Artificial Sequence
  Guide Sequence
aagaaauguggcuaucaucu

SEQ ID NO: 7423 - RNA, 20 nt, Artificial Sequence
  Guide Sequence
aagccccacccuucucaggg

SEQ ID NO: 7424 - RNA, 20 nt, Artificial Sequence
  Guide Sequence
aagggcgaggaagaaaugug

SEQ ID NO: 7425 - RNA, 20 nt, Artificial Sequence
  Guide Sequence
aagggcggaacugugacagg

SEQ ID NO: 7426 - RNA, 20 nt, Artificial Sequence
  Guide Sequence
aaguggcuguucccuggccg

SEQ ID NO: 7427 - RNA, 20 nt, Artificial Sequence
  Guide Sequence
aagugggaguaguaagggcg

SEQ ID NO: 7428 - RNA, 20 nt, Artificial Sequence
  Guide Sequence
aaguugcuucagcacggccg

SEQ ID NO: 7429 - RNA, 20 nt, Artificial Sequence
  Guide Sequence
aauguggcuaucaucuuccg

SEQ ID NO: 7430 - RNA, 20 nt, Artificial Sequence
  Guide Sequence
acaaccccuuuuccgggugg

SEQ ID NO: 7431 - RNA, 20 nt, Artificial Sequence
  Guide Sequence
acagcuggcgccccacggcg

SEQ ID NO: 7432 - RNA, 20 nt, Artificial Sequence
  Guide Sequence
acagggaaccuaggggaagg

SEQ ID NO: 7433 - RNA, 20 nt, Artificial Sequence
  Guide Sequence
accccacuccccagccccgg

SEQ ID NO: 7434 - RNA, 20 nt, Artificial Sequence
  Guide Sequence
accccuuuuccggguggaag

SEQ ID NO: 7435 - RNA, 20 nt, Artificial Sequence
  Guide Sequence
acccuucucagggcggaagu

SEQ ID NO: 7436 - RNA, 20 nt, Artificial Sequence
  Guide Sequence
accgccaggagucgcgagag

SEQ ID NO: 7437 - RNA, 20 nt, Artificial Sequence
  Guide Sequence
accgggcauguccgggccug

SEQ ID NO: 7438 - RNA, 20 nt, Artificial Sequence
  Guide Sequence
accuaggggaagggcgagga

SEQ ID NO: 7439 - RNA, 20 nt, Artificial Sequence
  Guide Sequence
acgcgcucugaggcuucggc

SEQ ID NO: 7440 - RNA, 20 nt, Artificial Sequence
  Guide Sequence
acgcucgguucccggacggc

SEQ ID NO: 7441 - RNA, 20 nt, Artificial Sequence
  Guide Sequence
acggaagccccacccuucuc

SEQ ID NO: 7442 - RNA, 20 nt, Artificial Sequence
  Guide Sequence
acggcgcugaccgggcaugu

SEQ ID NO: 7443 - RNA, 20 nt, Artificial Sequence
  Guide Sequence
acggcggaacaaccccuuuu

SEQ ID NO: 7444 - RNA, 20 nt, Artificial Sequence
  Guide Sequence
acguggccgcggcucuaggg

SEQ ID NO: 7445 - RNA, 20 nt, Artificial Sequence
  Guide Sequence
acuccccagccccgggacuc

SEQ ID NO: 7446 - RNA, 20 nt, Artificial Sequence
  Guide Sequence
acuccggacgccccacgcac

SEQ ID NO: 7447 - RNA, 20 nt, Artificial Sequence
  Guide Sequence
acugugacagggaaccuagg

SEQ ID NO: 7448 - RNA, 20 nt, Artificial Sequence
  Guide Sequence
agaaauguggcuaucaucuu

SEQ ID NO: 7449 - RNA, 20 nt, Artificial Sequence
  Guide Sequence
agacggaagccccacccuuc

SEQ ID NO: 7450 - RNA, 20 nt, Artificial Sequence
  Guide Sequence
agagcgggagacggaagccc

SEQ ID NO: 7451 - RNA, 20 nt, Artificial Sequence
  Guide Sequence
agccccacccuucucagggc

SEQ ID NO: 7452 - RNA, 20 nt, Artificial Sequence
  Guide Sequence
agccccgggacuccggacgc

SEQ ID NO: 7453 - RNA, 20 nt, Artificial Sequence
  Guide Sequence
agcgggagacggaagcccca

SEQ ID NO: 7454 - RNA, 20 nt, Artificial Sequence
  Guide Sequence
agcuggcgccccacggcgga

SEQ ID NO: 7455 - RNA, 20 nt, Artificial Sequence
  Guide Sequence
aggaagaaauguggcuauca

SEQ ID NO: 7456 - RNA, 20 nt, Artificial Sequence
  Guide Sequence
aggagucgcgagagcgggag

SEQ ID NO: 7457 - RNA, 20 nt, Artificial Sequence
  Guide Sequence
aggaugggugggccacagcu

SEQ ID NO: 7458 - RNA, 20 nt, Artificial Sequence
  Guide Sequence
aggcacgcgcucugaggcuu

SEQ ID NO: 7459 - RNA, 20 nt, Artificial Sequence
  Guide Sequence
agggaaccuaggggaagggc

SEQ ID NO: 7460 - RNA, 20 nt, Artificial Sequence
  Guide Sequence
agggcgaggaagaaaugugg

SEQ ID NO: 7461 - RNA, 20 nt, Artificial Sequence
  Guide Sequence
agggcggaacugugacaggg

SEQ ID NO: 7462 - RNA, 20 nt, Artificial Sequence
  Guide Sequence
agggcggaaguugcuucagc

SEQ ID NO: 7463 - RNA, 20 nt, Artificial Sequence
  Guide Sequence
aggggaagggcgaggaagaa

SEQ ID NO: 7464 - RNA, 20 nt, Artificial Sequence
  Guide Sequence
aguaagggcggaacugugac

SEQ ID NO: 7465 - RNA, 20 nt, Artificial Sequence
  Guide Sequence
aguaguaagggcggaacugu

SEQ ID NO: 7466 - RNA, 20 nt, Artificial Sequence
  Guide Sequence
agucgcgagagcgggagacg

SEQ ID NO: 7467 - RNA, 20 nt, Artificial Sequence
  Guide Sequence
aguggcuguucccuggccgg

SEQ ID NO: 7468 - RNA, 20 nt, Artificial Sequence
  Guide Sequence
agugggaguaguaagggcgg

SEQ ID NO: 7469 - RNA, 20 nt, Artificial Sequence
  Guide Sequence
aguugcuucagcacggccgg

SEQ ID NO: 7470 - RNA, 20 nt, Artificial Sequence
  Guide Sequence
aucaucuuccguccuucacc

SEQ ID NO: 7471 - RNA, 20 nt, Artificial Sequence
  Guide Sequence
aucuuccguccuucaccgcc

SEQ ID NO: 7472 - RNA, 20 nt, Artificial Sequence
  Guide Sequence
augggugggccacagcuggc

SEQ ID NO: 7473 - RNA, 20 nt, Artificial Sequence
  Guide Sequence
auguccgggccugccgcucg

SEQ ID NO: 7474 - RNA, 20 nt, Artificial Sequence
  Guide Sequence
auguggcuaucaucuuccgu

SEQ ID NO: 7475 - RNA, 20 nt, Artificial Sequence
  Guide Sequence
caaccccuuuuccgggugga

SEQ ID NO: 7476 - RNA, 20 nt, Artificial Sequence
  Guide Sequence
cacagcuggcgccccacggc

SEQ ID NO: 7477 - RNA, 20 nt, Artificial Sequence
  Guide Sequence
cacccuucucagggcggaag

SEQ ID NO: 7478 - RNA, 20 nt, Artificial Sequence
  Guide Sequence
caccgccaggagucgcgaga

SEQ ID NO: 7479 - RNA, 20 nt, Artificial Sequence
  Guide Sequence
cacgcgcucugaggcuucgg

SEQ ID NO: 7480 - RNA, 20 nt, Artificial Sequence
  Guide Sequence
cacgcucgguucccggacgg

SEQ ID NO: 7481 - RNA, 20 nt, Artificial Sequence
  Guide Sequence
cacggcggaacaaccccuuu

SEQ ID NO: 7482 - RNA, 20 nt, Artificial Sequence
  Guide Sequence
cacguggccgcggcucuagg

SEQ ID NO: 7483 - RNA, 20 nt, Artificial Sequence
  Guide Sequence
cacuccccagccccgggacu

SEQ ID NO: 7484 - RNA, 20 nt, Artificial Sequence
  Guide Sequence
cagccccgggacuccggacg

SEQ ID NO: 7485 - RNA, 20 nt, Artificial Sequence
  Guide Sequence
caggagucgcgagagcggga

SEQ ID NO: 7486 - RNA, 20 nt, Artificial Sequence
  Guide Sequence
caggaugggugggccacagc

SEQ ID NO: 7487 - RNA, 20 nt, Artificial Sequence
  Guide Sequence
caggcacgcgcucugaggcu

SEQ ID NO: 7488 - RNA, 20 nt, Artificial Sequence
  Guide Sequence
cagggaaccuaggggaaggg

SEQ ID NO: 7489 - RNA, 20 nt, Artificial Sequence
  Guide Sequence
cagggcggaaguugcuucag

SEQ ID NO: 7490 - RNA, 20 nt, Artificial Sequence
  Guide Sequence
caucuuccguccuucaccgc

SEQ ID NO: 7491 - RNA, 20 nt, Artificial Sequence
  Guide Sequence
cauguccgggccugccgcuc

SEQ ID NO: 7492 - RNA, 20 nt, Artificial Sequence
  Guide Sequence
ccacagcuggcgccccacgg

SEQ ID NO: 7493 - RNA, 20 nt, Artificial Sequence
  Guide Sequence
ccacccuucucagggcggaa

SEQ ID NO: 7494 - RNA, 20 nt, Artificial Sequence
  Guide Sequence
ccacgcucgguucccggacg

SEQ ID NO: 7495 - RNA, 20 nt, Artificial Sequence
  Guide Sequence
ccacggcggaacaaccccuu

SEQ ID NO: 7496 - RNA, 20 nt, Artificial Sequence
  Guide Sequence
ccacuccccagccccgggac

SEQ ID NO: 7497 - RNA, 20 nt, Artificial Sequence
  Guide Sequence
ccagccccgggacuccggac

SEQ ID NO: 7498 - RNA, 20 nt, Artificial Sequence
  Guide Sequence
ccaggagucgcgagagcggg

SEQ ID NO: 7499 - RNA, 20 nt, Artificial Sequence
  Guide Sequence
cccacccuucucagggcgga

SEQ ID NO: 7500 - RNA, 20 nt, Artificial Sequence
  Guide Sequence
cccacgcucgguucccggac

SEQ ID NO: 7501 - RNA, 20 nt, Artificial Sequence
  Guide Sequence
cccacggcggaacaaccccu

SEQ ID NO: 7502 - RNA, 20 nt, Artificial Sequence
  Guide Sequence
cccacuccccagccccggga

SEQ ID NO: 7503 - RNA, 20 nt, Artificial Sequence
  Guide Sequence
cccagccccgggacuccgga

SEQ ID NO: 7504 - RNA, 20 nt, Artificial Sequence
  Guide Sequence
ccccacccuucucagggcgg

SEQ ID NO: 7505 - RNA, 20 nt, Artificial Sequence
  Guide Sequence
ccccacggcggaacaacccc

SEQ ID NO: 7506 - RNA, 20 nt, Artificial Sequence
  Guide Sequence
ccccuuuuccggguggaagu

SEQ ID NO: 7507 - RNA, 20 nt, Artificial Sequence
  Guide Sequence
cccggggcccacgcucgguu

SEQ ID NO: 7508 - RNA, 20 nt, Artificial Sequence
  Guide Sequence
cccgguccagcucggagccc

SEQ ID NO: 7509 - RNA, 20 nt, Artificial Sequence
  Guide Sequence
cccucaggcacgcgcucuga

SEQ ID NO: 7510 - RNA, 20 nt, Artificial Sequence
  Guide Sequence
cccuggccggaagugggagu

SEQ ID NO: 7511 - RNA, 20 nt, Artificial Sequence
  Guide Sequence
cccuucucagggcggaaguu

SEQ ID NO: 7512 - RNA, 20 nt, Artificial Sequence
  Guide Sequence
cccuuuuccggguggaagug

SEQ ID NO: 7513 - RNA, 20 nt, Artificial Sequence
  Guide Sequence
ccgccaggagucgcgagagc

SEQ ID NO: 7514 - RNA, 20 nt, Artificial Sequence
  Guide Sequence
ccggaagugggaguaguaag

SEQ ID NO: 7515 - RNA, 20 nt, Artificial Sequence
  Guide Sequence
ccgggacuccggacgcccca

SEQ ID NO: 7516 - RNA, 20 nt, Artificial Sequence
  Guide Sequence
ccgggcauguccgggccugc

SEQ ID NO: 7517 - RNA, 20 nt, Artificial Sequence
  Guide Sequence
ccggggcccacgcucgguuc

SEQ ID NO: 7518 - RNA, 20 nt, Artificial Sequence
  Guide Sequence
ccggguggaaguggcuguuc

SEQ ID NO: 7519 - RNA, 20 nt, Artificial Sequence
  Guide Sequence
ccgguccagcucggagcccc

SEQ ID NO: 7520 - RNA, 20 nt, Artificial Sequence
  Guide Sequence
ccguccuucaccgccaggag

SEQ ID NO: 7521 - RNA, 20 nt, Artificial Sequence
  Guide Sequence
ccuaggggaagggcgaggaa

SEQ ID NO: 7522 - RNA, 20 nt, Artificial Sequence
  Guide Sequence
ccucaggcacgcgcucugag

SEQ ID NO: 7523 - RNA, 20 nt, Artificial Sequence
  Guide Sequence
ccucggggcccucaggcacg

SEQ ID NO: 7524 - RNA, 20 nt, Artificial Sequence
  Guide Sequence
ccugccgcucgcacguggcc

SEQ ID NO: 7525 - RNA, 20 nt, Artificial Sequence
  Guide Sequence
ccuggccggaagugggagua

SEQ ID NO: 7526 - RNA, 20 nt, Artificial Sequence
  Guide Sequence
ccuucaccgccaggagucgc

SEQ ID NO: 7527 - RNA, 20 nt, Artificial Sequence
  Guide Sequence
ccuucucagggcggaaguug

SEQ ID NO: 7528 - RNA, 20 nt, Artificial Sequence
  Guide Sequence
ccuuuuccggguggaagugg

SEQ ID NO: 7529 - RNA, 20 nt, Artificial Sequence
  Guide Sequence
cgaccccacuccccagcccc

SEQ ID NO: 7530 - RNA, 20 nt, Artificial Sequence
  Guide Sequence
cgagagcgggagacggaagc

SEQ ID NO: 7531 - RNA, 20 nt, Artificial Sequence
  Guide Sequence
cgaggaagaaauguggcuau

SEQ ID NO: 7532 - RNA, 20 nt, Artificial Sequence
  Guide Sequence
cgcacguggccgcggcucua

SEQ ID NO: 7533 - RNA, 20 nt, Artificial Sequence
  Guide Sequence
cgccaggagucgcgagagcg

SEQ ID NO: 7534 - RNA, 20 nt, Artificial Sequence
  Guide Sequence
cgccccacggcggaacaacc

SEQ ID NO: 7535 - RNA, 20 nt, Artificial Sequence
  Guide Sequence
cgcccgguccagcucggagc

SEQ ID NO: 7536 - RNA, 20 nt, Artificial Sequence
  Guide Sequence
cgccucggggcccucaggca

SEQ ID NO: 7537 - RNA, 20 nt, Artificial Sequence
  Guide Sequence
cgcgaccccacuccccagcc

SEQ ID NO: 7538 - RNA, 20 nt, Artificial Sequence
  Guide Sequence
cgcgagagcgggagacggaa

SEQ ID NO: 7539 - RNA, 20 nt, Artificial Sequence
  Guide Sequence
cgcgcccgguccagcucgga

SEQ ID NO: 7540 - RNA, 20 nt, Artificial Sequence
  Guide Sequence
cgcgcucugaggcuucggcg

SEQ ID NO: 7541 - RNA, 20 nt, Artificial Sequence
  Guide Sequence
cgcggcucuagggggcggga

SEQ ID NO: 7542 - RNA, 20 nt, Artificial Sequence
  Guide Sequence
cgcucgguucccggacggcg

SEQ ID NO: 7543 - RNA, 20 nt, Artificial Sequence
  Guide Sequence
cgcucugaggcuucggcguc

SEQ ID NO: 7544 - RNA, 20 nt, Artificial Sequence
  Guide Sequence
cgcugaccgggcauguccgg

SEQ ID NO: 7545 - RNA, 20 nt, Artificial Sequence
  Guide Sequence
cggaacaaccccuuuuccgg

SEQ ID NO: 7546 - RNA, 20 nt, Artificial Sequence
  Guide Sequence
cggaacugugacagggaacc

SEQ ID NO: 7547 - RNA, 20 nt, Artificial Sequence
  Guide Sequence
cggaagccccacccuucuca

SEQ ID NO: 7548 - RNA, 20 nt, Artificial Sequence
  Guide Sequence
cggaagugggaguaguaagg

SEQ ID NO: 7549 - RNA, 20 nt, Artificial Sequence
  Guide Sequence
cggaaguugcuucagcacgg

SEQ ID NO: 7550 - RNA, 20 nt, Artificial Sequence
  Guide Sequence
cggacggcgcugaccgggca

SEQ ID NO: 7551 - RNA, 20 nt, Artificial Sequence
  Guide Sequence
cggcgcugaccgggcauguc

SEQ ID NO: 7552 - RNA, 20 nt, Artificial Sequence
  Guide Sequence
cggcggaacaaccccuuuuc

SEQ ID NO: 7553 - RNA, 20 nt, Artificial Sequence
  Guide Sequence
cggcucuagggggcgggacg

SEQ ID NO: 7554 - RNA, 20 nt, Artificial Sequence
  Guide Sequence
cgggacuccggacgccccac

SEQ ID NO: 7555 - RNA, 20 nt, Artificial Sequence
  Guide Sequence
cgggagacggaagccccacc

SEQ ID NO: 7556 - RNA, 20 nt, Artificial Sequence
  Guide Sequence
cgggcauguccgggccugcc

SEQ ID NO: 7557 - RNA, 20 nt, Artificial Sequence
  Guide Sequence
cgggccugccgcucgcacgu

SEQ ID NO: 7558 - RNA, 20 nt, Artificial Sequence
  Guide Sequence
cggggcccacgcucgguucc

SEQ ID NO: 7559 - RNA, 20 nt, Artificial Sequence
  Guide Sequence
cggguggaaguggcuguucc

SEQ ID NO: 7560 - RNA, 20 nt, Artificial Sequence
  Guide Sequence
cgguccagcucggagccccc

SEQ ID NO: 7561 - RNA, 20 nt, Artificial Sequence
  Guide Sequence
cgguucccggacggcgcuga

SEQ ID NO: 7562 - RNA, 20 nt, Artificial Sequence
  Guide Sequence
cguccuucaccgccaggagu

SEQ ID NO: 7563 - RNA, 20 nt, Artificial Sequence
  Guide Sequence
cguggccgcggcucuagggg

SEQ ID NO: 7564 - RNA, 20 nt, Artificial Sequence
  Guide Sequence
cuaggggaagggcgaggaag

SEQ ID NO: 7565 - RNA, 20 nt, Artificial Sequence
  Guide Sequence
cuaucaucuuccguccuuca

SEQ ID NO: 7566 - RNA, 20 nt, Artificial Sequence
  Guide Sequence
cucaggcacgcgcucugagg

SEQ ID NO: 7567 - RNA, 20 nt, Artificial Sequence
  Guide Sequence
cucagggcggaaguugcuuc

SEQ ID NO: 7568 - RNA, 20 nt, Artificial Sequence
  Guide Sequence
cuccccagccccgggacucc

SEQ ID NO: 7569 - RNA, 20 nt, Artificial Sequence
  Guide Sequence
cuccggacgccccacgcacc

SEQ ID NO: 7570 - RNA, 20 nt, Artificial Sequence
  Guide Sequence
cucgcacguggccgcggcuc

SEQ ID NO: 7571 - RNA, 20 nt, Artificial Sequence
  Guide Sequence
cucggggcccucaggcacgc

SEQ ID NO: 7572 - RNA, 20 nt, Artificial Sequence
  Guide Sequence
cucgguucccggacggcgcu

SEQ ID NO: 7573 - RNA, 20 nt, Artificial Sequence
  Guide Sequence
cucuagggggcgggacgggc

SEQ ID NO: 7574 - RNA, 20 nt, Artificial Sequence
  Guide Sequence
cucugaggcuucggcguccg

SEQ ID NO: 7575 - RNA, 20 nt, Artificial Sequence
  Guide Sequence
cugaccgggcauguccgggc

SEQ ID NO: 7576 - RNA, 20 nt, Artificial Sequence
  Guide Sequence
cugaggcuucggcguccggc

SEQ ID NO: 7577 - RNA, 20 nt, Artificial Sequence
  Guide Sequence
cugccgcucgcacguggccg

SEQ ID NO: 7578 - RNA, 20 nt, Artificial Sequence
  Guide Sequence
cuggccggaagugggaguag

SEQ ID NO: 7579 - RNA, 20 nt, Artificial Sequence
  Guide Sequence
cuggcgccccacggcggaac

SEQ ID NO: 7580 - RNA, 20 nt, Artificial Sequence
  Guide Sequence
cugugacagggaaccuaggg

SEQ ID NO: 7581 - RNA, 20 nt, Artificial Sequence
  Guide Sequence
cuguucccuggccggaagug

SEQ ID NO: 7582 - RNA, 20 nt, Artificial Sequence
  Guide Sequence
cuucaccgccaggagucgcg

SEQ ID NO: 7583 - RNA, 20 nt, Artificial Sequence
  Guide Sequence
cuucagcacggccggggcga

SEQ ID NO: 7584 - RNA, 20 nt, Artificial Sequence
  Guide Sequence
cuuccguccuucaccgccag

SEQ ID NO: 7585 - RNA, 20 nt, Artificial Sequence
  Guide Sequence
cuucucagggcggaaguugc

SEQ ID NO: 7586 - RNA, 20 nt, Artificial Sequence
  Guide Sequence
cuuuuccggguggaaguggc

SEQ ID NO: 7587 - RNA, 20 nt, Artificial Sequence
  Guide Sequence
gaaauguggcuaucaucuuc

SEQ ID NO: 7588 - RNA, 20 nt, Artificial Sequence
  Guide Sequence
gaacaaccccuuuuccgggu

SEQ ID NO: 7589 - RNA, 20 nt, Artificial Sequence
  Guide Sequence
gaaccuaggggaagggcgag

SEQ ID NO: 7590 - RNA, 20 nt, Artificial Sequence
  Guide Sequence
gaacugugacagggaaccua

SEQ ID NO: 7591 - RNA, 20 nt, Artificial Sequence
  Guide Sequence
gaagaaauguggcuaucauc

SEQ ID NO: 7592 - RNA, 20 nt, Artificial Sequence
  Guide Sequence
gaagccccacccuucucagg

SEQ ID NO: 7593 - RNA, 20 nt, Artificial Sequence
  Guide Sequence
gaagggcgaggaagaaaugu

SEQ ID NO: 7594 - RNA, 20 nt, Artificial Sequence
  Guide Sequence
gaaguggcuguucccuggcc

SEQ ID NO: 7595 - RNA, 20 nt, Artificial Sequence
  Guide Sequence
gaagugggaguaguaagggc

SEQ ID NO: 7596 - RNA, 20 nt, Artificial Sequence
  Guide Sequence
gaaguugcuucagcacggcc

SEQ ID NO: 7597 - RNA, 20 nt, Artificial Sequence
  Guide Sequence
gacagggaaccuaggggaag

SEQ ID NO: 7598 - RNA, 20 nt, Artificial Sequence
  Guide Sequence
gaccccacuccccagccccg

SEQ ID NO: 7599 - RNA, 20 nt, Artificial Sequence
  Guide Sequence
gaccgggcauguccgggccu

SEQ ID NO: 7600 - RNA, 20 nt, Artificial Sequence
  Guide Sequence
gacggaagccccacccuucu

SEQ ID NO: 7601 - RNA, 20 nt, Artificial Sequence
  Guide Sequence
gacggcgcugaccgggcaug

SEQ ID NO: 7602 - RNA, 20 nt, Artificial Sequence
  Guide Sequence
gacuccggacgccccacgca

SEQ ID NO: 7603 - RNA, 20 nt, Artificial Sequence
  Guide Sequence
gagacggaagccccacccuu

SEQ ID NO: 7604 - RNA, 20 nt, Artificial Sequence
  Guide Sequence
gagagcgggagacggaagcc

SEQ ID NO: 7605 - RNA, 20 nt, Artificial Sequence
  Guide Sequence
gagcgggagacggaagcccc

SEQ ID NO: 7606 - RNA, 20 nt, Artificial Sequence
  Guide Sequence
gaggaagaaauguggcuauc

SEQ ID NO: 7607 - RNA, 20 nt, Artificial Sequence
  Guide Sequence
gaggcuucggcguccggccc

SEQ ID NO: 7608 - RNA, 20 nt, Artificial Sequence
  Guide Sequence
gaguaguaagggcggaacug

SEQ ID NO: 7609 - RNA, 20 nt, Artificial Sequence
  Guide Sequence
gagucgcgagagcgggagac

SEQ ID NO: 7610 - RNA, 20 nt, Artificial Sequence
  Guide Sequence
gaugggugggccacagcugg

SEQ ID NO: 7611 - RNA, 20 nt, Artificial Sequence
  Guide Sequence
gcacgcgcucugaggcuucg

SEQ ID NO: 7612 - RNA, 20 nt, Artificial Sequence
  Guide Sequence
gcacguggccgcggcucuag

SEQ ID NO: 7613 - RNA, 20 nt, Artificial Sequence
  Guide Sequence
gcaggaugggugggccacag

SEQ ID NO: 7614 - RNA, 20 nt, Artificial Sequence
  Guide Sequence
gcauguccgggccugccgcu

SEQ ID NO: 7615 - RNA, 20 nt, Artificial Sequence
  Guide Sequence
gccacagcuggcgccccacg

SEQ ID NO: 7616 - RNA, 20 nt, Artificial Sequence
  Guide Sequence
gccaggagucgcgagagcgg

SEQ ID NO: 7617 - RNA, 20 nt, Artificial Sequence
  Guide Sequence
gcccacgcucgguucccgga

SEQ ID NO: 7618 - RNA, 20 nt, Artificial Sequence
  Guide Sequence
gccccacccuucucagggcg

SEQ ID NO: 7619 - RNA, 20 nt, Artificial Sequence
  Guide Sequence
gccccacggcggaacaaccc

SEQ ID NO: 7620 - RNA, 20 nt, Artificial Sequence
  Guide Sequence
gcccgguccagcucggagcc

SEQ ID NO: 7621 - RNA, 20 nt, Artificial Sequence
  Guide Sequence
gcccucaggcacgcgcucug

SEQ ID NO: 7622 - RNA, 20 nt, Artificial Sequence
  Guide Sequence
gccggaagugggaguaguaa

SEQ ID NO: 7623 - RNA, 20 nt, Artificial Sequence
  Guide Sequence
gccucggggcccucaggcac

SEQ ID NO: 7624 - RNA, 20 nt, Artificial Sequence
  Guide Sequence
gccugccgcucgcacguggc

SEQ ID NO: 7625 - RNA, 20 nt, Artificial Sequence
  Guide Sequence
gcgaccccacuccccagccc

SEQ ID NO: 7626 - RNA, 20 nt, Artificial Sequence
  Guide Sequence
gcgagagcgggagacggaag

SEQ ID NO: 7627 - RNA, 20 nt, Artificial Sequence
  Guide Sequence
gcgaggaagaaauguggcua

SEQ ID NO: 7628 - RNA, 20 nt, Artificial Sequence
  Guide Sequence
gcgccccacggcggaacaac

SEQ ID NO: 7629 - RNA, 20 nt, Artificial Sequence
  Guide Sequence
gcgcccgguccagcucggag

SEQ ID NO: 7630 - RNA, 20 nt, Artificial Sequence
  Guide Sequence
gcgcucugaggcuucggcgu

SEQ ID NO: 7631 - RNA, 20 nt, Artificial Sequence
  Guide Sequence
gcgcugaccgggcauguccg

SEQ ID NO: 7632 - RNA, 20 nt, Artificial Sequence
  Guide Sequence
gcggaacaaccccuuuuccg

SEQ ID NO: 7633 - RNA, 20 nt, Artificial Sequence
  Guide Sequence
gcggaacugugacagggaac

SEQ ID NO: 7634 - RNA, 20 nt, Artificial Sequence
  Guide Sequence
gcggaaguugcuucagcacg

SEQ ID NO: 7635 - RNA, 20 nt, Artificial Sequence
  Guide Sequence
gcggcucuagggggcgggac

SEQ ID NO: 7636 - RNA, 20 nt, Artificial Sequence
  Guide Sequence
gcgggagacggaagccccac

SEQ ID NO: 7637 - RNA, 20 nt, Artificial Sequence
  Guide Sequence
gcuaucaucuuccguccuuc

SEQ ID NO: 7638 - RNA, 20 nt, Artificial Sequence
  Guide Sequence
gcucgcacguggccgcggcu

SEQ ID NO: 7639 - RNA, 20 nt, Artificial Sequence
  Guide Sequence
gcucgguucccggacggcgc

SEQ ID NO: 7640 - RNA, 20 nt, Artificial Sequence
  Guide Sequence
gcucuagggggcgggacggg

SEQ ID NO: 7641 - RNA, 20 nt, Artificial Sequence
  Guide Sequence
gcucugaggcuucggcgucc

SEQ ID NO: 7642 - RNA, 20 nt, Artificial Sequence
  Guide Sequence
gcugaccgggcauguccggg

SEQ ID NO: 7643 - RNA, 20 nt, Artificial Sequence
  Guide Sequence
gcuggcgccccacggcggaa

SEQ ID NO: 7644 - RNA, 20 nt, Artificial Sequence
  Guide Sequence
gcuguucccuggccggaagu

SEQ ID NO: 7645 - RNA, 20 nt, Artificial Sequence
  Guide Sequence
gcuucagcacggccggggcg

SEQ ID NO: 7646 - RNA, 20 nt, Artificial Sequence
  Guide Sequence
ggaacaaccccuuuuccggg

SEQ ID NO: 7647 - RNA, 20 nt, Artificial Sequence
  Guide Sequence
ggaaccuaggggaagggcga

SEQ ID NO: 7648 - RNA, 20 nt, Artificial Sequence
  Guide Sequence
ggaacugugacagggaaccu

SEQ ID NO: 7649 - RNA, 20 nt, Artificial Sequence
  Guide Sequence
ggaagaaauguggcuaucau

SEQ ID NO: 7650 - RNA, 20 nt, Artificial Sequence
  Guide Sequence
ggaagccccacccuucucag

SEQ ID NO: 7651 - RNA, 20 nt, Artificial Sequence
  Guide Sequence
ggaagggcgaggaagaaaug

SEQ ID NO: 7652 - RNA, 20 nt, Artificial Sequence
  Guide Sequence
ggaaguggcuguucccuggc

SEQ ID NO: 7653 - RNA, 20 nt, Artificial Sequence
  Guide Sequence
ggaagugggaguaguaaggg

SEQ ID NO: 7654 - RNA, 20 nt, Artificial Sequence
  Guide Sequence
ggaaguugcuucagcacggc

SEQ ID NO: 7655 - RNA, 20 nt, Artificial Sequence
  Guide Sequence
ggacggcgcugaccgggcau

SEQ ID NO: 7656 - RNA, 20 nt, Artificial Sequence
  Guide Sequence
ggacuccggacgccccacgc

SEQ ID NO: 7657 - RNA, 20 nt, Artificial Sequence
  Guide Sequence
ggagacggaagccccacccu

SEQ ID NO: 7658 - RNA, 20 nt, Artificial Sequence
  Guide Sequence
ggaguaguaagggcggaacu

SEQ ID NO: 7659 - RNA, 20 nt, Artificial Sequence
  Guide Sequence
ggagucgcgagagcgggaga

SEQ ID NO: 7660 - RNA, 20 nt, Artificial Sequence
  Guide Sequence
ggaugggugggccacagcug

SEQ ID NO: 7661 - RNA, 20 nt, Artificial Sequence
  Guide Sequence
ggcacgcgcucugaggcuuc

SEQ ID NO: 7662 - RNA, 20 nt, Artificial Sequence
  Guide Sequence
ggcaggaugggugggccaca

SEQ ID NO: 7663 - RNA, 20 nt, Artificial Sequence
  Guide Sequence
ggcauguccgggccugccgc

SEQ ID NO: 7664 - RNA, 20 nt, Artificial Sequence
  Guide Sequence
ggccacagcuggcgccccac

SEQ ID NO: 7665 - RNA, 20 nt, Artificial Sequence
  Guide Sequence
ggcccacgcucgguucccgg

SEQ ID NO: 7666 - RNA, 20 nt, Artificial Sequence
  Guide Sequence
ggcccucaggcacgcgcucu

SEQ ID NO: 7667 - RNA, 20 nt, Artificial Sequence
  Guide Sequence
ggccggaagugggaguagua

SEQ ID NO: 7668 - RNA, 20 nt, Artificial Sequence
  Guide Sequence
ggccugccgcucgcacgugg

SEQ ID NO: 7669 - RNA, 20 nt, Artificial Sequence
  Guide Sequence
ggcgaggaagaaauguggcu

SEQ ID NO: 7670 - RNA, 20 nt, Artificial Sequence
  Guide Sequence
ggcgccccacggcggaacaa

SEQ ID NO: 7671 - RNA, 20 nt, Artificial Sequence
  Guide Sequence
ggcgcugaccgggcaugucc

SEQ ID NO: 7672 - RNA, 20 nt, Artificial Sequence
  Guide Sequence
ggcggaacaaccccuuuucc

SEQ ID NO: 7673 - RNA, 20 nt, Artificial Sequence
  Guide Sequence
ggcggaacugugacagggaa

SEQ ID NO: 7674 - RNA, 20 nt, Artificial Sequence
  Guide Sequence
ggcggaaguugcuucagcac

SEQ ID NO: 7675 - RNA, 20 nt, Artificial Sequence
  Guide Sequence
ggcuaucaucuuccguccuu

SEQ ID NO: 7676 - RNA, 20 nt, Artificial Sequence
  Guide Sequence
ggcucuagggggcgggacgg

SEQ ID NO: 7677 - RNA, 20 nt, Artificial Sequence
  Guide Sequence
ggcuguucccuggccggaag

SEQ ID NO: 7678 - RNA, 20 nt, Artificial Sequence
  Guide Sequence
gggaaccuaggggaagggcg

SEQ ID NO: 7679 - RNA, 20 nt, Artificial Sequence
  Guide Sequence
gggaagggcgaggaagaaau

SEQ ID NO: 7680 - RNA, 20 nt, Artificial Sequence
  Guide Sequence
gggacuccggacgccccacg

SEQ ID NO: 7681 - RNA, 20 nt, Artificial Sequence
  Guide Sequence
gggagacggaagccccaccc

SEQ ID NO: 7682 - RNA, 20 nt, Artificial Sequence
  Guide Sequence
gggaguaguaagggcggaac

SEQ ID NO: 7683 - RNA, 20 nt, Artificial Sequence
  Guide Sequence
gggcaggaugggugggccac

SEQ ID NO: 7684 - RNA, 20 nt, Artificial Sequence
  Guide Sequence
gggcauguccgggccugccg

SEQ ID NO: 7685 - RNA, 20 nt, Artificial Sequence
  Guide Sequence
gggccacagcuggcgcccca

SEQ ID NO: 7686 - RNA, 20 nt, Artificial Sequence
  Guide Sequence
gggcccacgcucgguucccg

SEQ ID NO: 7687 - RNA, 20 nt, Artificial Sequence
  Guide Sequence
gggcccucaggcacgcgcuc

SEQ ID NO: 7688 - RNA, 20 nt, Artificial Sequence
  Guide Sequence
gggccugccgcucgcacgug

SEQ ID NO: 7689 - RNA, 20 nt, Artificial Sequence
  Guide Sequence
gggcgaggaagaaauguggc

SEQ ID NO: 7690 - RNA, 20 nt, Artificial Sequence
  Guide Sequence
gggcggaacugugacaggga

SEQ ID NO: 7691 - RNA, 20 nt, Artificial Sequence
  Guide Sequence
gggcggaaguugcuucagca

SEQ ID NO: 7692 - RNA, 20 nt, Artificial Sequence
  Guide Sequence
ggggaagggcgaggaagaaa

SEQ ID NO: 7693 - RNA, 20 nt, Artificial Sequence
  Guide Sequence
ggggcaggaugggugggcca

SEQ ID NO: 7694 - RNA, 20 nt, Artificial Sequence
  Guide Sequence
ggggcccacgcucgguuccc

SEQ ID NO: 7695 - RNA, 20 nt, Artificial Sequence
  Guide Sequence
ggggcccucaggcacgcgcu

SEQ ID NO: 7696 - RNA, 20 nt, Artificial Sequence
  Guide Sequence
ggguggaaguggcuguuccc

SEQ ID NO: 7697 - RNA, 20 nt, Artificial Sequence
  Guide Sequence
gggugggccacagcuggcgc

SEQ ID NO: 7698 - RNA, 20 nt, Artificial Sequence
  Guide Sequence
gguccagcucggagcccccg

SEQ ID NO: 7699 - RNA, 20 nt, Artificial Sequence
  Guide Sequence
gguggaaguggcuguucccu

SEQ ID NO: 7700 - RNA, 20 nt, Artificial Sequence
  Guide Sequence
ggugggccacagcuggcgcc

SEQ ID NO: 7701 - RNA, 20 nt, Artificial Sequence
  Guide Sequence
gguucccggacggcgcugac

SEQ ID NO: 7702 - RNA, 20 nt, Artificial Sequence
  Guide Sequence
guaagggcggaacugugaca

SEQ ID NO: 7703 - RNA, 20 nt, Artificial Sequence
  Guide Sequence
guaguaagggcggaacugug

SEQ ID NO: 7704 - RNA, 20 nt, Artificial Sequence
  Guide Sequence
guccagcucggagcccccgc

SEQ ID NO: 7705 - RNA, 20 nt, Artificial Sequence
  Guide Sequence
guccgggccugccgcucgca

SEQ ID NO: 7706 - RNA, 20 nt, Artificial Sequence
  Guide Sequence
guccuucaccgccaggaguc

SEQ ID NO: 7707 - RNA, 20 nt, Artificial Sequence
  Guide Sequence
gucgcgagagcgggagacgg

SEQ ID NO: 7708 - RNA, 20 nt, Artificial Sequence
  Guide Sequence
gugacagggaaccuagggga

SEQ ID NO: 7709 - RNA, 20 nt, Artificial Sequence
  Guide Sequence
guggaaguggcuguucccug

SEQ ID NO: 7710 - RNA, 20 nt, Artificial Sequence
  Guide Sequence
guggccgcggcucuaggggg

SEQ ID NO: 7711 - RNA, 20 nt, Artificial Sequence
  Guide Sequence
guggcuaucaucuuccgucc

SEQ ID NO: 7712 - RNA, 20 nt, Artificial Sequence
  Guide Sequence
guggcuguucccuggccgga

SEQ ID NO: 7713 - RNA, 20 nt, Artificial Sequence
  Guide Sequence
gugggaguaguaagggcgga

SEQ ID NO: 7714 - RNA, 20 nt, Artificial Sequence
  Guide Sequence
gugggccacagcuggcgccc

SEQ ID NO: 7715 - RNA, 20 nt, Artificial Sequence
  Guide Sequence
guucccggacggcgcugacc

SEQ ID NO: 7716 - RNA, 20 nt, Artificial Sequence
  Guide Sequence
guucccuggccggaaguggg

SEQ ID NO: 7717 - RNA, 20 nt, Artificial Sequence
  Guide Sequence
guugcuucagcacggccggg

SEQ ID NO: 7718 - RNA, 20 nt, Artificial Sequence
  Guide Sequence
uaagggcggaacugugacag

SEQ ID NO: 7719 - RNA, 20 nt, Artificial Sequence
  Guide Sequence
uaggggaagggcgaggaaga

SEQ ID NO: 7720 - RNA, 20 nt, Artificial Sequence
  Guide Sequence
uaguaagggcggaacuguga

SEQ ID NO: 7721 - RNA, 20 nt, Artificial Sequence
  Guide Sequence
uaucaucuuccguccuucac

SEQ ID NO: 7722 - RNA, 20 nt, Artificial Sequence
  Guide Sequence
ucaccgccaggagucgcgag

SEQ ID NO: 7723 - RNA, 20 nt, Artificial Sequence
  Guide Sequence
ucaggcacgcgcucugaggc

SEQ ID NO: 7724 - RNA, 20 nt, Artificial Sequence
  Guide Sequence
ucagggcggaaguugcuuca

SEQ ID NO: 7725 - RNA, 20 nt, Artificial Sequence
  Guide Sequence
ucaucuuccguccuucaccg

SEQ ID NO: 7726 - RNA, 20 nt, Artificial Sequence
  Guide Sequence
uccccagccccgggacuccg

SEQ ID NO: 7727 - RNA, 20 nt, Artificial Sequence
  Guide Sequence
ucccggacggcgcugaccgg

SEQ ID NO: 7728 - RNA, 20 nt, Artificial Sequence
  Guide Sequence
ucccuggccggaagugggag

SEQ ID NO: 7729 - RNA, 20 nt, Artificial Sequence
  Guide Sequence
uccggacgccccacgcaccc

SEQ ID NO: 7730 - RNA, 20 nt, Artificial Sequence
  Guide Sequence
uccgggccugccgcucgcac

SEQ ID NO: 7731 - RNA, 20 nt, Artificial Sequence
  Guide Sequence
uccggguggaaguggcuguu

SEQ ID NO: 7732 - RNA, 20 nt, Artificial Sequence
  Guide Sequence
uccguccuucaccgccagga

SEQ ID NO: 7733 - RNA, 20 nt, Artificial Sequence
  Guide Sequence
uccuucaccgccaggagucg

SEQ ID NO: 7734 - RNA, 20 nt, Artificial Sequence
  Guide Sequence
ucgcacguggccgcggcucu

SEQ ID NO: 7735 - RNA, 20 nt, Artificial Sequence
  Guide Sequence
ucgcgagagcgggagacgga

SEQ ID NO: 7736 - RNA, 20 nt, Artificial Sequence
  Guide Sequence
ucgcgcccgguccagcucgg

SEQ ID NO: 7737 - RNA, 20 nt, Artificial Sequence
  Guide Sequence
ucggggcccucaggcacgcg

SEQ ID NO: 7738 - RNA, 20 nt, Artificial Sequence
  Guide Sequence
ucgguucccggacggcgcug

SEQ ID NO: 7739 - RNA, 20 nt, Artificial Sequence
  Guide Sequence
ucuagggggcgggacgggcc

SEQ ID NO: 7740 - RNA, 20 nt, Artificial Sequence
  Guide Sequence
ucucagggcggaaguugcuu

SEQ ID NO: 7741 - RNA, 20 nt, Artificial Sequence
  Guide Sequence
ucugaggcuucggcguccgg

SEQ ID NO: 7742 - RNA, 20 nt, Artificial Sequence
  Guide Sequence
ucuuccguccuucaccgcca

SEQ ID NO: 7743 - RNA, 20 nt, Artificial Sequence
  Guide Sequence
ugacagggaaccuaggggaa

SEQ ID NO: 7744 - RNA, 20 nt, Artificial Sequence
  Guide Sequence
ugaccgggcauguccgggcc

SEQ ID NO: 7745 - RNA, 20 nt, Artificial Sequence
  Guide Sequence
ugaggcuucggcguccggcc

SEQ ID NO: 7746 - RNA, 20 nt, Artificial Sequence
  Guide Sequence
ugccgcucgcacguggccgc

SEQ ID NO: 7747 - RNA, 20 nt, Artificial Sequence
  Guide Sequence
ugcuucagcacggccggggc

SEQ ID NO: 7748 - RNA, 20 nt, Artificial Sequence
  Guide Sequence
uggaaguggcuguucccugg

SEQ ID NO: 7749 - RNA, 20 nt, Artificial Sequence
  Guide Sequence
uggccgcggcucuagggggc

SEQ ID NO: 7750 - RNA, 20 nt, Artificial Sequence
  Guide Sequence
uggccggaagugggaguagu

SEQ ID NO: 7751 - RNA, 20 nt, Artificial Sequence
  Guide Sequence
uggcgccccacggcggaaca

SEQ ID NO: 7752 - RNA, 20 nt, Artificial Sequence
  Guide Sequence
uggcuaucaucuuccguccu

SEQ ID NO: 7753 - RNA, 20 nt, Artificial Sequence
  Guide Sequence
uggcuguucccuggccggaa

SEQ ID NO: 7754 - RNA, 20 nt, Artificial Sequence
  Guide Sequence
ugggaguaguaagggcggaa

SEQ ID NO: 7755 - RNA, 20 nt, Artificial Sequence
  Guide Sequence
ugggccacagcuggcgcccc

SEQ ID NO: 7756 - RNA, 20 nt, Artificial Sequence
  Guide Sequence
ugggugggccacagcuggcg

SEQ ID NO: 7757 - RNA, 20 nt, Artificial Sequence
  Guide Sequence
uguccgggccugccgcucgc

SEQ ID NO: 7758 - RNA, 20 nt, Artificial Sequence
  Guide Sequence
ugugacagggaaccuagggg

SEQ ID NO: 7759 - RNA, 20 nt, Artificial Sequence
  Guide Sequence
uguggcuaucaucuuccguc

SEQ ID NO: 7760 - RNA, 20 nt, Artificial Sequence
  Guide Sequence
uguucccuggccggaagugg

SEQ ID NO: 7761 - RNA, 20 nt, Artificial Sequence
  Guide Sequence
uucaccgccaggagucgcga

SEQ ID NO: 7762 - RNA, 20 nt, Artificial Sequence
  Guide Sequence
uucagcacggccggggcgag

SEQ ID NO: 7763 - RNA, 20 nt, Artificial Sequence
  Guide Sequence
uucccggacggcgcugaccg

SEQ ID NO: 7764 - RNA, 20 nt, Artificial Sequence
  Guide Sequence
uucccuggccggaaguggga

SEQ ID NO: 7765 - RNA, 20 nt, Artificial Sequence
  Guide Sequence
uuccggguggaaguggcugu

SEQ ID NO: 7766 - RNA, 20 nt, Artificial Sequence
  Guide Sequence
uuccguccuucaccgccagg

SEQ ID NO: 7767 - RNA, 20 nt, Artificial Sequence
  Guide Sequence
uucucagggcggaaguugcu

SEQ ID NO: 7768 - RNA, 20 nt, Artificial Sequence
  Guide Sequence
uugcuucagcacggccgggg

SEQ ID NO: 7769 - RNA, 20 nt, Artificial Sequence
  Guide Sequence
uuuccggguggaaguggcug

SEQ ID NO: 7770 - RNA, 20 nt, Artificial Sequence
  Guide Sequence
uuuuccggguggaaguggcu

SEQ ID NO: 7771 - RNA, 21 nt, Artificial Sequence
  Guide Sequence
aaauguggcuaucaucuuccg

SEQ ID NO: 7772 - RNA, 21 nt, Artificial Sequence
  Guide Sequence
aacaaccccuuuuccgggugg

SEQ ID NO: 7773 - RNA, 21 nt, Artificial Sequence
  Guide Sequence
aaccccuuuuccggguggaag

SEQ ID NO: 7774 - RNA, 21 nt, Artificial Sequence
  Guide Sequence
aaccuaggggaagggcgagga

SEQ ID NO: 7775 - RNA, 21 nt, Artificial Sequence
  Guide Sequence
aacugugacagggaaccuagg

SEQ ID NO: 7776 - RNA, 21 nt, Artificial Sequence
  Guide Sequence
aagaaauguggcuaucaucuu

SEQ ID NO: 7777 - RNA, 21 nt, Artificial Sequence
  Guide Sequence
aagccccacccuucucagggc

SEQ ID NO: 7778 - RNA, 21 nt, Artificial Sequence
  Guide Sequence
aagggcgaggaagaaaugugg

SEQ ID NO: 7779 - RNA, 21 nt, Artificial Sequence
  Guide Sequence
aagggcggaacugugacaggg

SEQ ID NO: 7780 - RNA, 21 nt, Artificial Sequence
  Guide Sequence
aaguggcuguucccuggccgg

SEQ ID NO: 7781 - RNA, 21 nt, Artificial Sequence
  Guide Sequence
aagugggaguaguaagggcgg

SEQ ID NO: 7782 - RNA, 21 nt, Artificial Sequence
  Guide Sequence
aaguugcuucagcacggccgg

SEQ ID NO: 7783 - RNA, 21 nt, Artificial Sequence
  Guide Sequence
aauguggcuaucaucuuccgu

SEQ ID NO: 7784 - RNA, 21 nt, Artificial Sequence
  Guide Sequence
acaaccccuuuuccgggugga

SEQ ID NO: 7785 - RNA, 21 nt, Artificial Sequence
  Guide Sequence
acagggaaccuaggggaaggg

SEQ ID NO: 7786 - RNA, 21 nt, Artificial Sequence
  Guide Sequence
accccuuuuccggguggaagu

SEQ ID NO: 7787 - RNA, 21 nt, Artificial Sequence
  Guide Sequence
acccuucucagggcggaaguu

SEQ ID NO: 7788 - RNA, 21 nt, Artificial Sequence
  Guide Sequence
accgccaggagucgcgagagc

SEQ ID NO: 7789 - RNA, 21 nt, Artificial Sequence
  Guide Sequence
accgggcauguccgggccugc

SEQ ID NO: 7790 - RNA, 21 nt, Artificial Sequence
  Guide Sequence
accuaggggaagggcgaggaa

SEQ ID NO: 7791 - RNA, 21 nt, Artificial Sequence
  Guide Sequence
acgcgcucugaggcuucggcg

SEQ ID NO: 7792 - RNA, 21 nt, Artificial Sequence
  Guide Sequence
acgcucgguucccggacggcg

SEQ ID NO: 7793 - RNA, 21 nt, Artificial Sequence
  Guide Sequence
acggaagccccacccuucuca

SEQ ID NO: 7794 - RNA, 21 nt, Artificial Sequence
  Guide Sequence
acggcgcugaccgggcauguc

SEQ ID NO: 7795 - RNA, 21 nt, Artificial Sequence
  Guide Sequence
acggcggaacaaccccuuuuc

SEQ ID NO: 7796 - RNA, 21 nt, Artificial Sequence
  Guide Sequence
acguggccgcggcucuagggg

SEQ ID NO: 7797 - RNA, 21 nt, Artificial Sequence
  Guide Sequence
acuccccagccccgggacucc

SEQ ID NO: 7798 - RNA, 21 nt, Artificial Sequence
  Guide Sequence
acuccggacgccccacgcacc

SEQ ID NO: 7799 - RNA, 21 nt, Artificial Sequence
  Guide Sequence
acugugacagggaaccuaggg

SEQ ID NO: 7800 - RNA, 21 nt, Artificial Sequence
  Guide Sequence
agaaauguggcuaucaucuuc

SEQ ID NO: 7801 - RNA, 21 nt, Artificial Sequence
  Guide Sequence
agacggaagccccacccuucu

SEQ ID NO: 7802 - RNA, 21 nt, Artificial Sequence
  Guide Sequence
agagcgggagacggaagcccc

SEQ ID NO: 7803 - RNA, 21 nt, Artificial Sequence
  Guide Sequence
agccccacccuucucagggcg

SEQ ID NO: 7804 - RNA, 21 nt, Artificial Sequence
  Guide Sequence
agcgggagacggaagccccac

SEQ ID NO: 7805 - RNA, 21 nt, Artificial Sequence
  Guide Sequence
agcuggcgccccacggcggaa

SEQ ID NO: 7806 - RNA, 21 nt, Artificial Sequence
  Guide Sequence
aggaagaaauguggcuaucau

SEQ ID NO: 7807 - RNA, 21 nt, Artificial Sequence
  Guide Sequence
aggagucgcgagagcgggaga

SEQ ID NO: 7808 - RNA, 21 nt, Artificial Sequence
  Guide Sequence
aggaugggugggccacagcug

SEQ ID NO: 7809 - RNA, 21 nt, Artificial Sequence
  Guide Sequence
aggcacgcgcucugaggcuuc

SEQ ID NO: 7810 - RNA, 21 nt, Artificial Sequence
  Guide Sequence
agggaaccuaggggaagggcg

SEQ ID NO: 7811 - RNA, 21 nt, Artificial Sequence
  Guide Sequence
agggcgaggaagaaauguggc

SEQ ID NO: 7812 - RNA, 21 nt, Artificial Sequence
  Guide Sequence
agggcggaacugugacaggga

SEQ ID NO: 7813 - RNA, 21 nt, Artificial Sequence
  Guide Sequence
agggcggaaguugcuucagca

SEQ ID NO: 7814 - RNA, 21 nt, Artificial Sequence
  Guide Sequence
aggggaagggcgaggaagaaa

SEQ ID NO: 7815 - RNA, 21 nt, Artificial Sequence
  Guide Sequence
aguaagggcggaacugugaca

SEQ ID NO: 7816 - RNA, 21 nt, Artificial Sequence
  Guide Sequence
aguaguaagggcggaacugug

SEQ ID NO: 7817 - RNA, 21 nt, Artificial Sequence
  Guide Sequence
agucgcgagagcgggagacgg

SEQ ID NO: 7818 - RNA, 21 nt, Artificial Sequence
  Guide Sequence
aguggcuguucccuggccgga

SEQ ID NO: 7819 - RNA, 21 nt, Artificial Sequence
  Guide Sequence
agugggaguaguaagggcgga

SEQ ID NO: 7820 - RNA, 21 nt, Artificial Sequence
  Guide Sequence
aguugcuucagcacggccggg

SEQ ID NO: 7821 - RNA, 21 nt, Artificial Sequence
  Guide Sequence
aucaucuuccguccuucaccg

SEQ ID NO: 7822 - RNA, 21 nt, Artificial Sequence
  Guide Sequence
aucuuccguccuucaccgcca

SEQ ID NO: 7823 - RNA, 21 nt, Artificial Sequence
  Guide Sequence
augggugggccacagcuggcg

SEQ ID NO: 7824 - RNA, 21 nt, Artificial Sequence
  Guide Sequence
auguccgggccugccgcucgc

SEQ ID NO: 7825 - RNA, 21 nt, Artificial Sequence
  Guide Sequence
auguggcuaucaucuuccguc

SEQ ID NO: 7826 - RNA, 21 nt, Artificial Sequence
  Guide Sequence
caaccccuuuuccggguggaa

SEQ ID NO: 7827 - RNA, 21 nt, Artificial Sequence
  Guide Sequence
cacccuucucagggcggaagu

SEQ ID NO: 7828 - RNA, 21 nt, Artificial Sequence
  Guide Sequence
caccgccaggagucgcgagag

SEQ ID NO: 7829 - RNA, 21 nt, Artificial Sequence
  Guide Sequence
cacgcgcucugaggcuucggc

SEQ ID NO: 7830 - RNA, 21 nt, Artificial Sequence
  Guide Sequence
cacgcucgguucccggacggc

SEQ ID NO: 7831 - RNA, 21 nt, Artificial Sequence
  Guide Sequence
cacggcggaacaaccccuuuu

SEQ ID NO: 7832 - RNA, 21 nt, Artificial Sequence
  Guide Sequence
cacguggccgcggcucuaggg

SEQ ID NO: 7833 - RNA, 21 nt, Artificial Sequence
  Guide Sequence
cacuccccagccccgggacuc

SEQ ID NO: 7834 - RNA, 21 nt, Artificial Sequence
  Guide Sequence
caggagucgcgagagcgggag

SEQ ID NO: 7835 - RNA, 21 nt, Artificial Sequence
  Guide Sequence
caggaugggugggccacagcu

SEQ ID NO: 7836 - RNA, 21 nt, Artificial Sequence
  Guide Sequence
caggcacgcgcucugaggcuu

SEQ ID NO: 7837 - RNA, 21 nt, Artificial Sequence
  Guide Sequence
cagggaaccuaggggaagggc

SEQ ID NO: 7838 - RNA, 21 nt, Artificial Sequence
  Guide Sequence
cagggcggaaguugcuucagc

SEQ ID NO: 7839 - RNA, 21 nt, Artificial Sequence
  Guide Sequence
caucuuccguccuucaccgcc

SEQ ID NO: 7840 - RNA, 21 nt, Artificial Sequence
  Guide Sequence
cauguccgggccugccgcucg

SEQ ID NO: 7841 - RNA, 21 nt, Artificial Sequence
  Guide Sequence
ccacccuucucagggcggaag

SEQ ID NO: 7842 - RNA, 21 nt, Artificial Sequence
  Guide Sequence
ccacgcucgguucccggacgg

SEQ ID NO: 7843 - RNA, 21 nt, Artificial Sequence
  Guide Sequence
ccacggcggaacaaccccuuu

SEQ ID NO: 7844 - RNA, 21 nt, Artificial Sequence
  Guide Sequence
ccacuccccagccccgggacu

SEQ ID NO: 7845 - RNA, 21 nt, Artificial Sequence
  Guide Sequence
ccaggagucgcgagagcggga

SEQ ID NO: 7846 - RNA, 21 nt, Artificial Sequence
  Guide Sequence
cccacccuucucagggcggaa

SEQ ID NO: 7847 - RNA, 21 nt, Artificial Sequence
  Guide Sequence
cccacgcucgguucccggacg

SEQ ID NO: 7848 - RNA, 21 nt, Artificial Sequence
  Guide Sequence
cccacggcggaacaaccccuu

SEQ ID NO: 7849 - RNA, 21 nt, Artificial Sequence
  Guide Sequence
ccccacccuucucagggcgga

SEQ ID NO: 7850 - RNA, 21 nt, Artificial Sequence
  Guide Sequence
ccccacggcggaacaaccccu

SEQ ID NO: 7851 - RNA, 21 nt, Artificial Sequence
  Guide Sequence
ccccuuuuccggguggaagug

SEQ ID NO: 7852 - RNA, 21 nt, Artificial Sequence
  Guide Sequence
cccucaggcacgcgcucugag

SEQ ID NO: 7853 - RNA, 21 nt, Artificial Sequence
  Guide Sequence
cccuggccggaagugggagua

SEQ ID NO: 7854 - RNA, 21 nt, Artificial Sequence
  Guide Sequence
cccuucucagggcggaaguug

SEQ ID NO: 7855 - RNA, 21 nt, Artificial Sequence
  Guide Sequence
cccuuuuccggguggaagugg

SEQ ID NO: 7856 - RNA, 21 nt, Artificial Sequence
  Guide Sequence
ccgccaggagucgcgagagcg

SEQ ID NO: 7857 - RNA, 21 nt, Artificial Sequence
  Guide Sequence
ccggaagugggaguaguaagg

SEQ ID NO: 7858 - RNA, 21 nt, Artificial Sequence
  Guide Sequence
ccggguggaaguggcuguucc

SEQ ID NO: 7859 - RNA, 21 nt, Artificial Sequence
  Guide Sequence
ccguccuucaccgccaggagu

SEQ ID NO: 7860 - RNA, 21 nt, Artificial Sequence
  Guide Sequence
ccuaggggaagggcgaggaag

SEQ ID NO: 7861 - RNA, 21 nt, Artificial Sequence
  Guide Sequence
ccucaggcacgcgcucugagg

SEQ ID NO: 7862 - RNA, 21 nt, Artificial Sequence
  Guide Sequence
ccuggccggaagugggaguag

SEQ ID NO: 7863 - RNA, 21 nt, Artificial Sequence
  Guide Sequence
ccuucaccgccaggagucgcg

SEQ ID NO: 7864 - RNA, 21 nt, Artificial Sequence
  Guide Sequence
ccuucucagggcggaaguugc

SEQ ID NO: 7865 - RNA, 21 nt, Artificial Sequence
  Guide Sequence
ccuuuuccggguggaaguggc

SEQ ID NO: 7866 - RNA, 21 nt, Artificial Sequence
  Guide Sequence
cgagagcgggagacggaagcc

SEQ ID NO: 7867 - RNA, 21 nt, Artificial Sequence
  Guide Sequence
cgaggaagaaauguggcuauc

SEQ ID NO: 7868 - RNA, 21 nt, Artificial Sequence
  Guide Sequence
cgcacguggccgcggcucuag

SEQ ID NO: 7869 - RNA, 21 nt, Artificial Sequence
  Guide Sequence
cgccaggagucgcgagagcgg

SEQ ID NO: 7870 - RNA, 21 nt, Artificial Sequence
  Guide Sequence
cgccccacggcggaacaaccc

SEQ ID NO: 7871 - RNA, 21 nt, Artificial Sequence
  Guide Sequence
cgcgagagcgggagacggaag

SEQ ID NO: 7872 - RNA, 21 nt, Artificial Sequence
  Guide Sequence
cgcgcucugaggcuucggcgu

SEQ ID NO: 7873 - RNA, 21 nt, Artificial Sequence
  Guide Sequence
cgcucugaggcuucggcgucc

SEQ ID NO: 7874 - RNA, 21 nt, Artificial Sequence
  Guide Sequence
cgcugaccgggcauguccggg

SEQ ID NO: 7875 - RNA, 21 nt, Artificial Sequence
  Guide Sequence
cggaacaaccccuuuuccggg

SEQ ID NO: 7876 - RNA, 21 nt, Artificial Sequence
  Guide Sequence
cggaacugugacagggaaccu

SEQ ID NO: 7877 - RNA, 21 nt, Artificial Sequence
  Guide Sequence
cggaagccccacccuucucag

SEQ ID NO: 7878 - RNA, 21 nt, Artificial Sequence
  Guide Sequence
cggaagugggaguaguaaggg

SEQ ID NO: 7879 - RNA, 21 nt, Artificial Sequence
  Guide Sequence
cggaaguugcuucagcacggc

SEQ ID NO: 7880 - RNA, 21 nt, Artificial Sequence
  Guide Sequence
cggacggcgcugaccgggcau

SEQ ID NO: 7881 - RNA, 21 nt, Artificial Sequence
  Guide Sequence
cggcgcugaccgggcaugucc

SEQ ID NO: 7882 - RNA, 21 nt, Artificial Sequence
  Guide Sequence
cggcggaacaaccccuuuucc

SEQ ID NO: 7883 - RNA, 21 nt, Artificial Sequence
  Guide Sequence
cgggagacggaagccccaccc

SEQ ID NO: 7884 - RNA, 21 nt, Artificial Sequence
  Guide Sequence
cggguggaaguggcuguuccc

SEQ ID NO: 7885 - RNA, 21 nt, Artificial Sequence
  Guide Sequence
cgguucccggacggcgcugac

SEQ ID NO: 7886 - RNA, 21 nt, Artificial Sequence
  Guide Sequence
cguccuucaccgccaggaguc

SEQ ID NO: 7887 - RNA, 21 nt, Artificial Sequence
  Guide Sequence
cuaggggaagggcgaggaaga

SEQ ID NO: 7888 - RNA, 21 nt, Artificial Sequence
  Guide Sequence
cuaucaucuuccguccuucac

SEQ ID NO: 7889 - RNA, 21 nt, Artificial Sequence
  Guide Sequence
cucaggcacgcgcucugaggc

SEQ ID NO: 7890 - RNA, 21 nt, Artificial Sequence
  Guide Sequence
cucagggcggaaguugcuuca

SEQ ID NO: 7891 - RNA, 21 nt, Artificial Sequence
  Guide Sequence
cucgcacguggccgcggcucu

SEQ ID NO: 7892 - RNA, 21 nt, Artificial Sequence
  Guide Sequence
cucgguucccggacggcgcug

SEQ ID NO: 7893 - RNA, 21 nt, Artificial Sequence
  Guide Sequence
cucugaggcuucggcguccgg

SEQ ID NO: 7894 - RNA, 21 nt, Artificial Sequence
  Guide Sequence
cugaccgggcauguccgggcc

SEQ ID NO: 7895 - RNA, 21 nt, Artificial Sequence
  Guide Sequence
cugaggcuucggcguccggcc

SEQ ID NO: 7896 - RNA, 21 nt, Artificial Sequence
  Guide Sequence
cuggccggaagugggaguagu

SEQ ID NO: 7897 - RNA, 21 nt, Artificial Sequence
  Guide Sequence
cuggcgccccacggcggaaca

SEQ ID NO: 7898 - RNA, 21 nt, Artificial Sequence
  Guide Sequence
cugugacagggaaccuagggg

SEQ ID NO: 7899 - RNA, 21 nt, Artificial Sequence
  Guide Sequence
cuguucccuggccggaagugg

SEQ ID NO: 7900 - RNA, 21 nt, Artificial Sequence
  Guide Sequence
cuucaccgccaggagucgcga

SEQ ID NO: 7901 - RNA, 21 nt, Artificial Sequence
  Guide Sequence
cuucagcacggccggggcgag

SEQ ID NO: 7902 - RNA, 21 nt, Artificial Sequence
  Guide Sequence
cuuccguccuucaccgccagg

SEQ ID NO: 7903 - RNA, 21 nt, Artificial Sequence
  Guide Sequence
cuucucagggcggaaguugcu

SEQ ID NO: 7904 - RNA, 21 nt, Artificial Sequence
  Guide Sequence
cuuuuccggguggaaguggcu

SEQ ID NO: 7905 - RNA, 21 nt, Artificial Sequence
  Guide Sequence
gaaauguggcuaucaucuucc

SEQ ID NO: 7906 - RNA, 21 nt, Artificial Sequence
  Guide Sequence
gaacaaccccuuuuccgggug

SEQ ID NO: 7907 - RNA, 21 nt, Artificial Sequence
  Guide Sequence
gaaccuaggggaagggcgagg

SEQ ID NO: 7908 - RNA, 21 nt, Artificial Sequence
  Guide Sequence
gaacugugacagggaaccuag

SEQ ID NO: 7909 - RNA, 21 nt, Artificial Sequence
  Guide Sequence
gaagaaauguggcuaucaucu

SEQ ID NO: 7910 - RNA, 21 nt, Artificial Sequence
  Guide Sequence
gaagccccacccuucucaggg

SEQ ID NO: 7911 - RNA, 21 nt, Artificial Sequence
  Guide Sequence
gaagggcgaggaagaaaugug

SEQ ID NO: 7912 - RNA, 21 nt, Artificial Sequence
  Guide Sequence
gaaguggcuguucccuggccg

SEQ ID NO: 7913 - RNA, 21 nt, Artificial Sequence
  Guide Sequence
gaagugggaguaguaagggcg

SEQ ID NO: 7914 - RNA, 21 nt, Artificial Sequence
  Guide Sequence
gaaguugcuucagcacggccg

SEQ ID NO: 7915 - RNA, 21 nt, Artificial Sequence
  Guide Sequence
gacagggaaccuaggggaagg

SEQ ID NO: 7916 - RNA, 21 nt, Artificial Sequence
  Guide Sequence
gaccgggcauguccgggccug

SEQ ID NO: 7917 - RNA, 21 nt, Artificial Sequence
  Guide Sequence
gacggaagccccacccuucuc

SEQ ID NO: 7918 - RNA, 21 nt, Artificial Sequence
  Guide Sequence
gacggcgcugaccgggcaugu

SEQ ID NO: 7919 - RNA, 21 nt, Artificial Sequence
  Guide Sequence
gacuccggacgccccacgcac

SEQ ID NO: 7920 - RNA, 21 nt, Artificial Sequence
  Guide Sequence
gagacggaagccccacccuuc

SEQ ID NO: 7921 - RNA, 21 nt, Artificial Sequence
  Guide Sequence
gagagcgggagacggaagccc

SEQ ID NO: 7922 - RNA, 21 nt, Artificial Sequence
  Guide Sequence
gagcgggagacggaagcccca

SEQ ID NO: 7923 - RNA, 21 nt, Artificial Sequence
  Guide Sequence
gaggaagaaauguggcuauca

SEQ ID NO: 7924 - RNA, 21 nt, Artificial Sequence
  Guide Sequence
gaguaguaagggcggaacugu

SEQ ID NO: 7925 - RNA, 21 nt, Artificial Sequence
  Guide Sequence
gagucgcgagagcgggagacg

SEQ ID NO: 7926 - RNA, 21 nt, Artificial Sequence
  Guide Sequence
gaugggugggccacagcuggc

SEQ ID NO: 7927 - RNA, 21 nt, Artificial Sequence
  Guide Sequence
gcacgcgcucugaggcuucgg

SEQ ID NO: 7928 - RNA, 21 nt, Artificial Sequence
  Guide Sequence
gcacguggccgcggcucuagg

SEQ ID NO: 7929 - RNA, 21 nt, Artificial Sequence
  Guide Sequence
gcaggaugggugggccacagc

SEQ ID NO: 7930 - RNA, 21 nt, Artificial Sequence
  Guide Sequence
gcauguccgggccugccgcuc

SEQ ID NO: 7931 - RNA, 21 nt, Artificial Sequence
  Guide Sequence
gccaggagucgcgagagcggg

SEQ ID NO: 7932 - RNA, 21 nt, Artificial Sequence
  Guide Sequence
gcccacgcucgguucccggac

SEQ ID NO: 7933 - RNA, 21 nt, Artificial Sequence
  Guide Sequence
gccccacccuucucagggcgg

SEQ ID NO: 7934 - RNA, 21 nt, Artificial Sequence
  Guide Sequence
gccccacggcggaacaacccc

SEQ ID NO: 7935 - RNA, 21 nt, Artificial Sequence
  Guide Sequence
gcccucaggcacgcgcucuga

SEQ ID NO: 7936 - RNA, 21 nt, Artificial Sequence
  Guide Sequence
gccggaagugggaguaguaag

SEQ ID NO: 7937 - RNA, 21 nt, Artificial Sequence
  Guide Sequence
gcgagagcgggagacggaagc

SEQ ID NO: 7938 - RNA, 21 nt, Artificial Sequence
  Guide Sequence
gcgaggaagaaauguggcuau

SEQ ID NO: 7939 - RNA, 21 nt, Artificial Sequence
  Guide Sequence
gcgccccacggcggaacaacc

SEQ ID NO: 7940 - RNA, 21 nt, Artificial Sequence
  Guide Sequence
gcgcucugaggcuucggcguc

SEQ ID NO: 7941 - RNA, 21 nt, Artificial Sequence
  Guide Sequence
gcgcugaccgggcauguccgg

SEQ ID NO: 7942 - RNA, 21 nt, Artificial Sequence
  Guide Sequence
gcggaacaaccccuuuuccgg

SEQ ID NO: 7943 - RNA, 21 nt, Artificial Sequence
  Guide Sequence
gcggaacugugacagggaacc

SEQ ID NO: 7944 - RNA, 21 nt, Artificial Sequence
  Guide Sequence
gcggaaguugcuucagcacgg

SEQ ID NO: 7945 - RNA, 21 nt, Artificial Sequence
  Guide Sequence
gcgggagacggaagccccacc

SEQ ID NO: 7946 - RNA, 21 nt, Artificial Sequence
  Guide Sequence
gcuaucaucuuccguccuuca

SEQ ID NO: 7947 - RNA, 21 nt, Artificial Sequence
  Guide Sequence
gcucgguucccggacggcgcu

SEQ ID NO: 7948 - RNA, 21 nt, Artificial Sequence
  Guide Sequence
gcucugaggcuucggcguccg

SEQ ID NO: 7949 - RNA, 21 nt, Artificial Sequence
  Guide Sequence
gcugaccgggcauguccgggc

SEQ ID NO: 7950 - RNA, 21 nt, Artificial Sequence
  Guide Sequence
gcuguucccuggccggaagug

SEQ ID NO: 7951 - RNA, 21 nt, Artificial Sequence
  Guide Sequence
gcuucagcacggccggggcga

SEQ ID NO: 7952 - RNA, 21 nt, Artificial Sequence
  Guide Sequence
ggaacaaccccuuuuccgggu

SEQ ID NO: 7953 - RNA, 21 nt, Artificial Sequence
  Guide Sequence
ggaaccuaggggaagggcgag

SEQ ID NO: 7954 - RNA, 21 nt, Artificial Sequence
  Guide Sequence
ggaacugugacagggaaccua

SEQ ID NO: 7955 - RNA, 21 nt, Artificial Sequence
  Guide Sequence
ggaagaaauguggcuaucauc

SEQ ID NO: 7956 - RNA, 21 nt, Artificial Sequence
  Guide Sequence
ggaagccccacccuucucagg

SEQ ID NO: 7957 - RNA, 21 nt, Artificial Sequence
  Guide Sequence
ggaagggcgaggaagaaaugu

SEQ ID NO: 7958 - RNA, 21 nt, Artificial Sequence
  Guide Sequence
ggaaguggcuguucccuggcc

SEQ ID NO: 7959 - RNA, 21 nt, Artificial Sequence
  Guide Sequence
ggaagugggaguaguaagggc

SEQ ID NO: 7960 - RNA, 21 nt, Artificial Sequence
  Guide Sequence
ggaaguugcuucagcacggcc

SEQ ID NO: 7961 - RNA, 21 nt, Artificial Sequence
  Guide Sequence
ggacggcgcugaccgggcaug

SEQ ID NO: 7962 - RNA, 21 nt, Artificial Sequence
  Guide Sequence
ggacuccggacgccccacgca

SEQ ID NO: 7963 - RNA, 21 nt, Artificial Sequence
  Guide Sequence
ggagacggaagccccacccuu

SEQ ID NO: 7964 - RNA, 21 nt, Artificial Sequence
  Guide Sequence
ggaguaguaagggcggaacug

SEQ ID NO: 7965 - RNA, 21 nt, Artificial Sequence
  Guide Sequence
ggagucgcgagagcgggagac

SEQ ID NO: 7966 - RNA, 21 nt, Artificial Sequence
  Guide Sequence
ggaugggugggccacagcugg

SEQ ID NO: 7967 - RNA, 21 nt, Artificial Sequence
  Guide Sequence
ggcacgcgcucugaggcuucg

SEQ ID NO: 7968 - RNA, 21 nt, Artificial Sequence
  Guide Sequence
ggcaggaugggugggccacag

SEQ ID NO: 7969 - RNA, 21 nt, Artificial Sequence
  Guide Sequence
ggcauguccgggccugccgcu

SEQ ID NO: 7970 - RNA, 21 nt, Artificial Sequence
  Guide Sequence
ggcccacgcucgguucccgga

SEQ ID NO: 7971 - RNA, 21 nt, Artificial Sequence
  Guide Sequence
ggcccucaggcacgcgcucug

SEQ ID NO: 7972 - RNA, 21 nt, Artificial Sequence
  Guide Sequence
ggccggaagugggaguaguaa

SEQ ID NO: 7973 - RNA, 21 nt, Artificial Sequence
  Guide Sequence
ggcgaggaagaaauguggcua

SEQ ID NO: 7974 - RNA, 21 nt, Artificial Sequence
  Guide Sequence
ggcgccccacggcggaacaac

SEQ ID NO: 7975 - RNA, 21 nt, Artificial Sequence
  Guide Sequence
ggcgcugaccgggcauguccg

SEQ ID NO: 7976 - RNA, 21 nt, Artificial Sequence
  Guide Sequence
ggcggaacaaccccuuuuccg

SEQ ID NO: 7977 - RNA, 21 nt, Artificial Sequence
  Guide Sequence
ggcggaacugugacagggaac

SEQ ID NO: 7978 - RNA, 21 nt, Artificial Sequence
  Guide Sequence
ggcggaaguugcuucagcacg

SEQ ID NO: 7979 - RNA, 21 nt, Artificial Sequence
  Guide Sequence
ggcuaucaucuuccguccuuc

SEQ ID NO: 7980 - RNA, 21 nt, Artificial Sequence
  Guide Sequence
ggcuguucccuggccggaagu

SEQ ID NO: 7981 - RNA, 21 nt, Artificial Sequence
  Guide Sequence
gggaaccuaggggaagggcga

SEQ ID NO: 7982 - RNA, 21 nt, Artificial Sequence
  Guide Sequence
gggaagggcgaggaagaaaug

SEQ ID NO: 7983 - RNA, 21 nt, Artificial Sequence
  Guide Sequence
gggagacggaagccccacccu

SEQ ID NO: 7984 - RNA, 21 nt, Artificial Sequence
  Guide Sequence
gggaguaguaagggcggaacu

SEQ ID NO: 7985 - RNA, 21 nt, Artificial Sequence
  Guide Sequence
gggcaggaugggugggccaca

SEQ ID NO: 7986 - RNA, 21 nt, Artificial Sequence
  Guide Sequence
gggcccucaggcacgcgcucu

SEQ ID NO: 7987 - RNA, 21 nt, Artificial Sequence
  Guide Sequence
gggcgaggaagaaauguggcu

SEQ ID NO: 7988 - RNA, 21 nt, Artificial Sequence
  Guide Sequence
gggcggaacugugacagggaa

SEQ ID NO: 7989 - RNA, 21 nt, Artificial Sequence
  Guide Sequence
gggcggaaguugcuucagcac

SEQ ID NO: 7990 - RNA, 21 nt, Artificial Sequence
  Guide Sequence
ggggaagggcgaggaagaaau

SEQ ID NO: 7991 - RNA, 21 nt, Artificial Sequence
  Guide Sequence
ggggcaggaugggugggccac

SEQ ID NO: 7992 - RNA, 21 nt, Artificial Sequence
  Guide Sequence
ggguggaaguggcuguucccu

SEQ ID NO: 7993 - RNA, 21 nt, Artificial Sequence
  Guide Sequence
gguggaaguggcuguucccug

SEQ ID NO: 7994 - RNA, 21 nt, Artificial Sequence
  Guide Sequence
gguucccggacggcgcugacc

SEQ ID NO: 7995 - RNA, 21 nt, Artificial Sequence
  Guide Sequence
guaagggcggaacugugacag

SEQ ID NO: 7996 - RNA, 21 nt, Artificial Sequence
  Guide Sequence
guaguaagggcggaacuguga

SEQ ID NO: 7997 - RNA, 21 nt, Artificial Sequence
  Guide Sequence
guccuucaccgccaggagucg

SEQ ID NO: 7998 - RNA, 21 nt, Artificial Sequence
  Guide Sequence
gucgcgagagcgggagacgga

SEQ ID NO: 7999 - RNA, 21 nt, Artificial Sequence
  Guide Sequence
gugacagggaaccuaggggaa

SEQ ID NO: 8000 - RNA, 21 nt, Artificial Sequence
  Guide Sequence
guggaaguggcuguucccugg

SEQ ID NO: 8001 - RNA, 21 nt, Artificial Sequence
  Guide Sequence
guggcuaucaucuuccguccu

SEQ ID NO: 8002 - RNA, 21 nt, Artificial Sequence
  Guide Sequence
guggcuguucccuggccggaa

SEQ ID NO: 8003 - RNA, 21 nt, Artificial Sequence
  Guide Sequence
gugggaguaguaagggcggaa

SEQ ID NO: 8004 - RNA, 21 nt, Artificial Sequence
  Guide Sequence
guucccggacggcgcugaccg

SEQ ID NO: 8005 - RNA, 21 nt, Artificial Sequence
  Guide Sequence
guucccuggccggaaguggga

SEQ ID NO: 8006 - RNA, 21 nt, Artificial Sequence
  Guide Sequence
guugcuucagcacggccgggg

SEQ ID NO: 8007 - RNA, 21 nt, Artificial Sequence
  Guide Sequence
uaagggcggaacugugacagg

SEQ ID NO: 8008 - RNA, 21 nt, Artificial Sequence
  Guide Sequence
uaggggaagggcgaggaagaa

SEQ ID NO: 8009 - RNA, 21 nt, Artificial Sequence
  Guide Sequence
uaguaagggcggaacugugac

SEQ ID NO: 8010 - RNA, 21 nt, Artificial Sequence
  Guide Sequence
uaucaucuuccguccuucacc

SEQ ID NO: 8011 - RNA, 21 nt, Artificial Sequence
  Guide Sequence
ucaccgccaggagucgcgaga

SEQ ID NO: 8012 - RNA, 21 nt, Artificial Sequence
  Guide Sequence
ucaggcacgcgcucugaggcu

SEQ ID NO: 8013 - RNA, 21 nt, Artificial Sequence
  Guide Sequence
ucagggcggaaguugcuucag

SEQ ID NO: 8014 - RNA, 21 nt, Artificial Sequence
  Guide Sequence
ucaucuuccguccuucaccgc

SEQ ID NO: 8015 - RNA, 21 nt, Artificial Sequence
  Guide Sequence
ucccuggccggaagugggagu

SEQ ID NO: 8016 - RNA, 21 nt, Artificial Sequence
  Guide Sequence
uccggguggaaguggcuguuc

SEQ ID NO: 8017 - RNA, 21 nt, Artificial Sequence
  Guide Sequence
uccguccuucaccgccaggag

SEQ ID NO: 8018 - RNA, 21 nt, Artificial Sequence
  Guide Sequence
uccuucaccgccaggagucgc

SEQ ID NO: 8019 - RNA, 21 nt, Artificial Sequence
  Guide Sequence
ucgcacguggccgcggcucua

SEQ ID NO: 8020 - RNA, 21 nt, Artificial Sequence
  Guide Sequence
ucgcgagagcgggagacggaa

SEQ ID NO: 8021 - RNA, 21 nt, Artificial Sequence
  Guide Sequence
ucgcgcccgguccagcucgga

SEQ ID NO: 8022 - RNA, 21 nt, Artificial Sequence
  Guide Sequence
ucgguucccggacggcgcuga

SEQ ID NO: 8023 - RNA, 21 nt, Artificial Sequence
  Guide Sequence
ucucagggcggaaguugcuuc

SEQ ID NO: 8024 - RNA, 21 nt, Artificial Sequence
  Guide Sequence
ucugaggcuucggcguccggc

SEQ ID NO: 8025 - RNA, 21 nt, Artificial Sequence
  Guide Sequence
ucuuccguccuucaccgccag

SEQ ID NO: 8026 - RNA, 21 nt, Artificial Sequence
  Guide Sequence
ugacagggaaccuaggggaag

SEQ ID NO: 8027 - RNA, 21 nt, Artificial Sequence
  Guide Sequence
ugaccgggcauguccgggccu

SEQ ID NO: 8028 - RNA, 21 nt, Artificial Sequence
  Guide Sequence
ugaggcuucggcguccggccc

SEQ ID NO: 8029 - RNA, 21 nt, Artificial Sequence
  Guide Sequence
ugcuucagcacggccggggcg

SEQ ID NO: 8030 - RNA, 21 nt, Artificial Sequence
  Guide Sequence
uggaaguggcuguucccuggc

SEQ ID NO: 8031 - RNA, 21 nt, Artificial Sequence
  Guide Sequence
uggccggaagugggaguagua

SEQ ID NO: 8032 - RNA, 21 nt, Artificial Sequence
  Guide Sequence
uggcgccccacggcggaacaa

SEQ ID NO: 8033 - RNA, 21 nt, Artificial Sequence
  Guide Sequence
uggcuaucaucuuccguccuu

SEQ ID NO: 8034 - RNA, 21 nt, Artificial Sequence
  Guide Sequence
uggcuguucccuggccggaag

SEQ ID NO: 8035 - RNA, 21 nt, Artificial Sequence
  Guide Sequence
ugggaguaguaagggcggaac

SEQ ID NO: 8036 - RNA, 21 nt, Artificial Sequence
  Guide Sequence
ugggccacagcuggcgcccca

SEQ ID NO: 8037 - RNA, 21 nt, Artificial Sequence
  Guide Sequence
ugggugggccacagcuggcgc

SEQ ID NO: 8038 - RNA, 21 nt, Artificial Sequence
  Guide Sequence
uguccgggccugccgcucgca

SEQ ID NO: 8039 - RNA, 21 nt, Artificial Sequence
  Guide Sequence
ugugacagggaaccuagggga

SEQ ID NO: 8040 - RNA, 21 nt, Artificial Sequence
  Guide Sequence
uguggcuaucaucuuccgucc

SEQ ID NO: 8041 - RNA, 21 nt, Artificial Sequence
  Guide Sequence
uguucccuggccggaaguggg

SEQ ID NO: 8042 - RNA, 21 nt, Artificial Sequence
  Guide Sequence
uucaccgccaggagucgcgag

SEQ ID NO: 8043 - RNA, 21 nt, Artificial Sequence
  Guide Sequence
uucccggacggcgcugaccgg

SEQ ID NO: 8044 - RNA, 21 nt, Artificial Sequence
  Guide Sequence
uucccuggccggaagugggag

SEQ ID NO: 8045 - RNA, 21 nt, Artificial Sequence
  Guide Sequence
uuccggguggaaguggcuguu

SEQ ID NO: 8046 - RNA, 21 nt, Artificial Sequence
  Guide Sequence
uuccguccuucaccgccagga

SEQ ID NO: 8047 - RNA, 21 nt, Artificial Sequence
  Guide Sequence
uucucagggcggaaguugcuu

SEQ ID NO: 8048 - RNA, 21 nt, Artificial Sequence
  Guide Sequence
uugcuucagcacggccggggc

SEQ ID NO: 8049 - RNA, 21 nt, Artificial Sequence
  Guide Sequence
uuuccggguggaaguggcugu

SEQ ID NO: 8050 - RNA, 21 nt, Artificial Sequence
  Guide Sequence
uuuuccggguggaaguggcug

SEQ ID NO: 8051 - RNA, 22 nt, Artificial Sequence
  Guide Sequence
aaauguggcuaucaucuuccgu

SEQ ID NO: 8052 - RNA, 22 nt, Artificial Sequence
  Guide Sequence
aacaaccccuuuuccgggugga

SEQ ID NO: 8053 - RNA, 22 nt, Artificial Sequence
  Guide Sequence
aaccccuuuuccggguggaagu

SEQ ID NO: 8054 - RNA, 22 nt, Artificial Sequence
  Guide Sequence
aaccuaggggaagggcgaggaa

SEQ ID NO: 8055 - RNA, 22 nt, Artificial Sequence
  Guide Sequence
aacugugacagggaaccuaggg

SEQ ID NO: 8056 - RNA, 22 nt, Artificial Sequence
  Guide Sequence
aagaaauguggcuaucaucuuc

SEQ ID NO: 8057 - RNA, 22 nt, Artificial Sequence
  Guide Sequence
aagccccacccuucucagggcg

SEQ ID NO: 8058 - RNA, 22 nt, Artificial Sequence
  Guide Sequence
aagggcgaggaagaaauguggc

SEQ ID NO: 8059 - RNA, 22 nt, Artificial Sequence
  Guide Sequence
aagggcggaacugugacaggga

SEQ ID NO: 8060 - RNA, 22 nt, Artificial Sequence
  Guide Sequence
aaguggcuguucccuggccgga

SEQ ID NO: 8061 - RNA, 22 nt, Artificial Sequence
  Guide Sequence
aagugggaguaguaagggcgga

SEQ ID NO: 8062 - RNA, 22 nt, Artificial Sequence
  Guide Sequence
aaguugcuucagcacggccggg

SEQ ID NO: 8063 - RNA, 22 nt, Artificial Sequence
  Guide Sequence
aauguggcuaucaucuuccguc

SEQ ID NO: 8064 - RNA, 22 nt, Artificial Sequence
  Guide Sequence
acaaccccuuuuccggguggaa

SEQ ID NO: 8065 - RNA, 22 nt, Artificial Sequence
  Guide Sequence
acagcuggcgccccacggcgga

SEQ ID NO: 8066 - RNA, 22 nt, Artificial Sequence
  Guide Sequence
acagggaaccuaggggaagggc

SEQ ID NO: 8067 - RNA, 22 nt, Artificial Sequence
  Guide Sequence
accccacuccccagccccggga

SEQ ID NO: 8068 - RNA, 22 nt, Artificial Sequence
  Guide Sequence
accccuuuuccggguggaagug

SEQ ID NO: 8069 - RNA, 22 nt, Artificial Sequence
  Guide Sequence
acccuucucagggcggaaguug

SEQ ID NO: 8070 - RNA, 22 nt, Artificial Sequence
  Guide Sequence
accgccaggagucgcgagagcg

SEQ ID NO: 8071 - RNA, 22 nt, Artificial Sequence
  Guide Sequence
accgggcauguccgggccugcc

SEQ ID NO: 8072 - RNA, 22 nt, Artificial Sequence
  Guide Sequence
accuaggggaagggcgaggaag

SEQ ID NO: 8073 - RNA, 22 nt, Artificial Sequence
  Guide Sequence
acgcgcucugaggcuucggcgu

SEQ ID NO: 8074 - RNA, 22 nt, Artificial Sequence
  Guide Sequence
acgcucgguucccggacggcgc

SEQ ID NO: 8075 - RNA, 22 nt, Artificial Sequence
  Guide Sequence
acggaagccccacccuucucag

SEQ ID NO: 8076 - RNA, 22 nt, Artificial Sequence
  Guide Sequence
acggcgcugaccgggcaugucc

SEQ ID NO: 8077 - RNA, 22 nt, Artificial Sequence
  Guide Sequence
acggcggaacaaccccuuuucc

SEQ ID NO: 8078 - RNA, 22 nt, Artificial Sequence
  Guide Sequence
acguggccgcggcucuaggggg

SEQ ID NO: 8079 - RNA, 22 nt, Artificial Sequence
  Guide Sequence
acuccccagccccgggacuccg

SEQ ID NO: 8080 - RNA, 22 nt, Artificial Sequence
  Guide Sequence
acuccggacgccccacgcaccc

SEQ ID NO: 8081 - RNA, 22 nt, Artificial Sequence
  Guide Sequence
acugugacagggaaccuagggg

SEQ ID NO: 8082 - RNA, 22 nt, Artificial Sequence
  Guide Sequence
agaaauguggcuaucaucuucc

SEQ ID NO: 8083 - RNA, 22 nt, Artificial Sequence
  Guide Sequence
agacggaagccccacccuucuc

SEQ ID NO: 8084 - RNA, 22 nt, Artificial Sequence
  Guide Sequence
agagcgggagacggaagcccca

SEQ ID NO: 8085 - RNA, 22 nt, Artificial Sequence
  Guide Sequence
agccccacccuucucagggcgg

SEQ ID NO: 8086 - RNA, 22 nt, Artificial Sequence
  Guide Sequence
agcgggagacggaagccccacc

SEQ ID NO: 8087 - RNA, 22 nt, Artificial Sequence
  Guide Sequence
agcuggcgccccacggcggaac

SEQ ID NO: 8088 - RNA, 22 nt, Artificial Sequence
  Guide Sequence
aggaagaaauguggcuaucauc

SEQ ID NO: 8089 - RNA, 22 nt, Artificial Sequence
  Guide Sequence
aggagucgcgagagcgggagac

SEQ ID NO: 8090 - RNA, 22 nt, Artificial Sequence
  Guide Sequence
aggaugggugggccacagcugg

SEQ ID NO: 8091 - RNA, 22 nt, Artificial Sequence
  Guide Sequence
aggcacgcgcucugaggcuucg

SEQ ID NO: 8092 - RNA, 22 nt, Artificial Sequence
  Guide Sequence
agggaaccuaggggaagggcga

SEQ ID NO: 8093 - RNA, 22 nt, Artificial Sequence
  Guide Sequence
agggcgaggaagaaauguggcu

SEQ ID NO: 8094 - RNA, 22 nt, Artificial Sequence
  Guide Sequence
agggcggaacugugacagggaa

SEQ ID NO: 8095 - RNA, 22 nt, Artificial Sequence
  Guide Sequence
agggcggaaguugcuucagcac

SEQ ID NO: 8096 - RNA, 22 nt, Artificial Sequence
  Guide Sequence
aggggaagggcgaggaagaaau

SEQ ID NO: 8097 - RNA, 22 nt, Artificial Sequence
  Guide Sequence
aguaagggcggaacugugacag

SEQ ID NO: 8098 - RNA, 22 nt, Artificial Sequence
  Guide Sequence
aguaguaagggcggaacuguga

SEQ ID NO: 8099 - RNA, 22 nt, Artificial Sequence
  Guide Sequence
agucgcgagagcgggagacgga

SEQ ID NO: 8100 - RNA, 22 nt, Artificial Sequence
  Guide Sequence
aguggcuguucccuggccggaa

SEQ ID NO: 8101 - RNA, 22 nt, Artificial Sequence
  Guide Sequence
agugggaguaguaagggcggaa

SEQ ID NO: 8102 - RNA, 22 nt, Artificial Sequence
  Guide Sequence
aguugcuucagcacggccgggg

SEQ ID NO: 8103 - RNA, 22 nt, Artificial Sequence
  Guide Sequence
aucaucuuccguccuucaccgc

SEQ ID NO: 8104 - RNA, 22 nt, Artificial Sequence
  Guide Sequence
aucuuccguccuucaccgccag

SEQ ID NO: 8105 - RNA, 22 nt, Artificial Sequence
  Guide Sequence
augggugggccacagcuggcgc

SEQ ID NO: 8106 - RNA, 22 nt, Artificial Sequence
  Guide Sequence
auguccgggccugccgcucgca

SEQ ID NO: 8107 - RNA, 22 nt, Artificial Sequence
  Guide Sequence
auguggcuaucaucuuccgucc

SEQ ID NO: 8108 - RNA, 22 nt, Artificial Sequence
  Guide Sequence
caaccccuuuuccggguggaag

SEQ ID NO: 8109 - RNA, 22 nt, Artificial Sequence
  Guide Sequence
cacccuucucagggcggaaguu

SEQ ID NO: 8110 - RNA, 22 nt, Artificial Sequence
  Guide Sequence
caccgccaggagucgcgagagc

SEQ ID NO: 8111 - RNA, 22 nt, Artificial Sequence
  Guide Sequence
cacgcgcucugaggcuucggcg

SEQ ID NO: 8112 - RNA, 22 nt, Artificial Sequence
  Guide Sequence
cacgcucgguucccggacggcg

SEQ ID NO: 8113 - RNA, 22 nt, Artificial Sequence
  Guide Sequence
cacggcggaacaaccccuuuuc

SEQ ID NO: 8114 - RNA, 22 nt, Artificial Sequence
  Guide Sequence
cacguggccgcggcucuagggg

SEQ ID NO: 8115 - RNA, 22 nt, Artificial Sequence
  Guide Sequence
cacuccccagccccgggacucc

SEQ ID NO: 8116 - RNA, 22 nt, Artificial Sequence
  Guide Sequence
cagcuggcgccccacggcggaa

SEQ ID NO: 8117 - RNA, 22 nt, Artificial Sequence
  Guide Sequence
caggagucgcgagagcgggaga

SEQ ID NO: 8118 - RNA, 22 nt, Artificial Sequence
  Guide Sequence
caggaugggugggccacagcug

SEQ ID NO: 8119 - RNA, 22 nt, Artificial Sequence
  Guide Sequence
caggcacgcgcucugaggcuuc

SEQ ID NO: 8120 - RNA, 22 nt, Artificial Sequence
  Guide Sequence
cagggaaccuaggggaagggcg

SEQ ID NO: 8121 - RNA, 22 nt, Artificial Sequence
  Guide Sequence
cagggcggaaguugcuucagca

SEQ ID NO: 8122 - RNA, 22 nt, Artificial Sequence
  Guide Sequence
caucuuccguccuucaccgcca

SEQ ID NO: 8123 - RNA, 22 nt, Artificial Sequence
  Guide Sequence
cauguccgggccugccgcucgc

SEQ ID NO: 8124 - RNA, 22 nt, Artificial Sequence
  Guide Sequence
ccacccuucucagggcggaagu

SEQ ID NO: 8125 - RNA, 22 nt, Artificial Sequence
  Guide Sequence
ccacgcucgguucccggacggc

SEQ ID NO: 8126 - RNA, 22 nt, Artificial Sequence
  Guide Sequence
ccacggcggaacaaccccuuuu

SEQ ID NO: 8127 - RNA, 22 nt, Artificial Sequence
  Guide Sequence
ccacuccccagccccgggacuc

SEQ ID NO: 8128 - RNA, 22 nt, Artificial Sequence
  Guide Sequence
ccaggagucgcgagagcgggag

SEQ ID NO: 8129 - RNA, 22 nt, Artificial Sequence
  Guide Sequence
cccacccuucucagggcggaag

SEQ ID NO: 8130 - RNA, 22 nt, Artificial Sequence
  Guide Sequence
cccacgcucgguucccggacgg

SEQ ID NO: 8131 - RNA, 22 nt, Artificial Sequence
  Guide Sequence
cccacggcggaacaaccccuuu

SEQ ID NO: 8132 - RNA, 22 nt, Artificial Sequence
  Guide Sequence
cccacuccccagccccgggacu

SEQ ID NO: 8133 - RNA, 22 nt, Artificial Sequence
  Guide Sequence
ccccacccuucucagggcggaa

SEQ ID NO: 8134 - RNA, 22 nt, Artificial Sequence
  Guide Sequence
ccccacggcggaacaaccccuu

SEQ ID NO: 8135 - RNA, 22 nt, Artificial Sequence
  Guide Sequence
ccccuuuuccggguggaagugg

SEQ ID NO: 8136 - RNA, 22 nt, Artificial Sequence
  Guide Sequence
cccucaggcacgcgcucugagg

SEQ ID NO: 8137 - RNA, 22 nt, Artificial Sequence
  Guide Sequence
cccuggccggaagugggaguag

SEQ ID NO: 8138 - RNA, 22 nt, Artificial Sequence
  Guide Sequence
cccuucucagggcggaaguugc

SEQ ID NO: 8139 - RNA, 22 nt, Artificial Sequence
  Guide Sequence
cccuuuuccggguggaaguggc

SEQ ID NO: 8140 - RNA, 22 nt, Artificial Sequence
  Guide Sequence
ccgccaggagucgcgagagcgg

SEQ ID NO: 8141 - RNA, 22 nt, Artificial Sequence
  Guide Sequence
ccggaagugggaguaguaaggg

SEQ ID NO: 8142 - RNA, 22 nt, Artificial Sequence
  Guide Sequence
ccggacggcgcugaccgggcau

SEQ ID NO: 8143 - RNA, 22 nt, Artificial Sequence
  Guide Sequence
ccggguggaaguggcuguuccc

SEQ ID NO: 8144 - RNA, 22 nt, Artificial Sequence
  Guide Sequence
ccguccuucaccgccaggaguc

SEQ ID NO: 8145 - RNA, 22 nt, Artificial Sequence
  Guide Sequence
ccuaggggaagggcgaggaaga

SEQ ID NO: 8146 - RNA, 22 nt, Artificial Sequence
  Guide Sequence
ccucaggcacgcgcucugaggc

SEQ ID NO: 8147 - RNA, 22 nt, Artificial Sequence
  Guide Sequence
ccuggccggaagugggaguagu

SEQ ID NO: 8148 - RNA, 22 nt, Artificial Sequence
  Guide Sequence
ccuucaccgccaggagucgcga

SEQ ID NO: 8149 - RNA, 22 nt, Artificial Sequence
  Guide Sequence
ccuucucagggcggaaguugcu

SEQ ID NO: 8150 - RNA, 22 nt, Artificial Sequence
  Guide Sequence
ccuuuuccggguggaaguggcu

SEQ ID NO: 8151 - RNA, 22 nt, Artificial Sequence
  Guide Sequence
cgagagcgggagacggaagccc

SEQ ID NO: 8152 - RNA, 22 nt, Artificial Sequence
  Guide Sequence
cgaggaagaaauguggcuauca

SEQ ID NO: 8153 - RNA, 22 nt, Artificial Sequence
  Guide Sequence
cgcacguggccgcggcucuagg

SEQ ID NO: 8154 - RNA, 22 nt, Artificial Sequence
  Guide Sequence
cgccaggagucgcgagagcggg

SEQ ID NO: 8155 - RNA, 22 nt, Artificial Sequence
  Guide Sequence
cgccccacggcggaacaacccc

SEQ ID NO: 8156 - RNA, 22 nt, Artificial Sequence
  Guide Sequence
cgcgagagcgggagacggaagc

SEQ ID NO: 8157 - RNA, 22 nt, Artificial Sequence
  Guide Sequence
cgcgcucugaggcuucggcguc

SEQ ID NO: 8158 - RNA, 22 nt, Artificial Sequence
  Guide Sequence
cgcucgguucccggacggcgcu

SEQ ID NO: 8159 - RNA, 22 nt, Artificial Sequence
  Guide Sequence
cgcucugaggcuucggcguccg

SEQ ID NO: 8160 - RNA, 22 nt, Artificial Sequence
  Guide Sequence
cgcugaccgggcauguccgggc

SEQ ID NO: 8161 - RNA, 22 nt, Artificial Sequence
  Guide Sequence
cggaacaaccccuuuuccgggu

SEQ ID NO: 8162 - RNA, 22 nt, Artificial Sequence
  Guide Sequence
cggaacugugacagggaaccua

SEQ ID NO: 8163 - RNA, 22 nt, Artificial Sequence
  Guide Sequence
cggaagccccacccuucucagg

SEQ ID NO: 8164 - RNA, 22 nt, Artificial Sequence
  Guide Sequence
cggaagugggaguaguaagggc

SEQ ID NO: 8165 - RNA, 22 nt, Artificial Sequence
  Guide Sequence
cggaaguugcuucagcacggcc

SEQ ID NO: 8166 - RNA, 22 nt, Artificial Sequence
  Guide Sequence
cggacggcgcugaccgggcaug

SEQ ID NO: 8167 - RNA, 22 nt, Artificial Sequence
  Guide Sequence
cggcgcugaccgggcauguccg

SEQ ID NO: 8168 - RNA, 22 nt, Artificial Sequence
  Guide Sequence
cggcggaacaaccccuuuuccg

SEQ ID NO: 8169 - RNA, 22 nt, Artificial Sequence
  Guide Sequence
cgggagacggaagccccacccu

SEQ ID NO: 8170 - RNA, 22 nt, Artificial Sequence
  Guide Sequence
cggguggaaguggcuguucccu

SEQ ID NO: 8171 - RNA, 22 nt, Artificial Sequence
  Guide Sequence
cgguucccggacggcgcugacc

SEQ ID NO: 8172 - RNA, 22 nt, Artificial Sequence
  Guide Sequence
cguccuucaccgccaggagucg

SEQ ID NO: 8173 - RNA, 22 nt, Artificial Sequence
  Guide Sequence
cuaggggaagggcgaggaagaa

SEQ ID NO: 8174 - RNA, 22 nt, Artificial Sequence
  Guide Sequence
cuaucaucuuccguccuucacc

SEQ ID NO: 8175 - RNA, 22 nt, Artificial Sequence
  Guide Sequence
cucaggcacgcgcucugaggcu

SEQ ID NO: 8176 - RNA, 22 nt, Artificial Sequence
  Guide Sequence
cucagggcggaaguugcuucag

SEQ ID NO: 8177 - RNA, 22 nt, Artificial Sequence
  Guide Sequence
cucgcacguggccgcggcucua

SEQ ID NO: 8178 - RNA, 22 nt, Artificial Sequence
  Guide Sequence
cucgcgcccgguccagcucgga

SEQ ID NO: 8179 - RNA, 22 nt, Artificial Sequence
  Guide Sequence
cucgguucccggacggcgcuga

SEQ ID NO: 8180 - RNA, 22 nt, Artificial Sequence
  Guide Sequence
cucugaggcuucggcguccggc

SEQ ID NO: 8181 - RNA, 22 nt, Artificial Sequence
  Guide Sequence
cugaccgggcauguccgggccu

SEQ ID NO: 8182 - RNA, 22 nt, Artificial Sequence
  Guide Sequence
cugaggcuucggcguccggccc

SEQ ID NO: 8183 - RNA, 22 nt, Artificial Sequence
  Guide Sequence
cuggccggaagugggaguagua

SEQ ID NO: 8184 - RNA, 22 nt, Artificial Sequence
  Guide Sequence
cuggcgccccacggcggaacaa

SEQ ID NO: 8185 - RNA, 22 nt, Artificial Sequence
  Guide Sequence
cugugacagggaaccuagggga

SEQ ID NO: 8186 - RNA, 22 nt, Artificial Sequence
  Guide Sequence
cuguucccuggccggaaguggg

SEQ ID NO: 8187 - RNA, 22 nt, Artificial Sequence
  Guide Sequence
cuucaccgccaggagucgcgag

SEQ ID NO: 8188 - RNA, 22 nt, Artificial Sequence
  Guide Sequence
cuuccguccuucaccgccagga

SEQ ID NO: 8189 - RNA, 22 nt, Artificial Sequence
  Guide Sequence
cuucucagggcggaaguugcuu

SEQ ID NO: 8190 - RNA, 22 nt, Artificial Sequence
  Guide Sequence
cuuuuccggguggaaguggcug

SEQ ID NO: 8191 - RNA, 22 nt, Artificial Sequence
  Guide Sequence
gaaauguggcuaucaucuuccg

SEQ ID NO: 8192 - RNA, 22 nt, Artificial Sequence
  Guide Sequence
gaacaaccccuuuuccgggugg

SEQ ID NO: 8193 - RNA, 22 nt, Artificial Sequence
  Guide Sequence
gaaccuaggggaagggcgagga

SEQ ID NO: 8194 - RNA, 22 nt, Artificial Sequence
  Guide Sequence
gaacugugacagggaaccuagg

SEQ ID NO: 8195 - RNA, 22 nt, Artificial Sequence
  Guide Sequence
gaagaaauguggcuaucaucuu

SEQ ID NO: 8196 - RNA, 22 nt, Artificial Sequence
  Guide Sequence
gaagccccacccuucucagggc

SEQ ID NO: 8197 - RNA, 22 nt, Artificial Sequence
  Guide Sequence
gaagggcgaggaagaaaugugg

SEQ ID NO: 8198 - RNA, 22 nt, Artificial Sequence
  Guide Sequence
gaaguggcuguucccuggccgg

SEQ ID NO: 8199 - RNA, 22 nt, Artificial Sequence
  Guide Sequence
gaagugggaguaguaagggcgg

SEQ ID NO: 8200 - RNA, 22 nt, Artificial Sequence
  Guide Sequence
gaaguugcuucagcacggccgg

SEQ ID NO: 8201 - RNA, 22 nt, Artificial Sequence
  Guide Sequence
gacagggaaccuaggggaaggg

SEQ ID NO: 8202 - RNA, 22 nt, Artificial Sequence
  Guide Sequence
gaccgggcauguccgggccugc

SEQ ID NO: 8203 - RNA, 22 nt, Artificial Sequence
  Guide Sequence
gacggaagccccacccuucuca

SEQ ID NO: 8204 - RNA, 22 nt, Artificial Sequence
  Guide Sequence
gacggcgcugaccgggcauguc

SEQ ID NO: 8205 - RNA, 22 nt, Artificial Sequence
  Guide Sequence
gacuccggacgccccacgcacc

SEQ ID NO: 8206 - RNA, 22 nt, Artificial Sequence
  Guide Sequence
gagacggaagccccacccuucu

SEQ ID NO: 8207 - RNA, 22 nt, Artificial Sequence
  Guide Sequence
gagagcgggagacggaagcccc

SEQ ID NO: 8208 - RNA, 22 nt, Artificial Sequence
  Guide Sequence
gagcgggagacggaagccccac

SEQ ID NO: 8209 - RNA, 22 nt, Artificial Sequence
  Guide Sequence
gaggaagaaauguggcuaucau

SEQ ID NO: 8210 - RNA, 22 nt, Artificial Sequence
  Guide Sequence
gaguaguaagggcggaacugug

SEQ ID NO: 8211 - RNA, 22 nt, Artificial Sequence
  Guide Sequence
gagucgcgagagcgggagacgg

SEQ ID NO: 8212 - RNA, 22 nt, Artificial Sequence
  Guide Sequence
gaugggugggccacagcuggcg

SEQ ID NO: 8213 - RNA, 22 nt, Artificial Sequence
  Guide Sequence
gcacgcgcucugaggcuucggc

SEQ ID NO: 8214 - RNA, 22 nt, Artificial Sequence
  Guide Sequence
gcacguggccgcggcucuaggg

SEQ ID NO: 8215 - RNA, 22 nt, Artificial Sequence
  Guide Sequence
gcaggaugggugggccacagcu

SEQ ID NO: 8216 - RNA, 22 nt, Artificial Sequence
  Guide Sequence
gcauguccgggccugccgcucg

SEQ ID NO: 8217 - RNA, 22 nt, Artificial Sequence
  Guide Sequence
gccaggagucgcgagagcggga

SEQ ID NO: 8218 - RNA, 22 nt, Artificial Sequence
  Guide Sequence
gcccacgcucgguucccggacg

SEQ ID NO: 8219 - RNA, 22 nt, Artificial Sequence
  Guide Sequence
gccccacccuucucagggcgga

SEQ ID NO: 8220 - RNA, 22 nt, Artificial Sequence
  Guide Sequence
gccccacggcggaacaaccccu

SEQ ID NO: 8221 - RNA, 22 nt, Artificial Sequence
  Guide Sequence
gcccucaggcacgcgcucugag

SEQ ID NO: 8222 - RNA, 22 nt, Artificial Sequence
  Guide Sequence
gccggaagugggaguaguaagg

SEQ ID NO: 8223 - RNA, 22 nt, Artificial Sequence
  Guide Sequence
gcgagagcgggagacggaagcc

SEQ ID NO: 8224 - RNA, 22 nt, Artificial Sequence
  Guide Sequence
gcgaggaagaaauguggcuauc

SEQ ID NO: 8225 - RNA, 22 nt, Artificial Sequence
  Guide Sequence
gcgccccacggcggaacaaccc

SEQ ID NO: 8226 - RNA, 22 nt, Artificial Sequence
  Guide Sequence
gcgcucugaggcuucggcgucc

SEQ ID NO: 8227 - RNA, 22 nt, Artificial Sequence
  Guide Sequence
gcgcugaccgggcauguccggg

SEQ ID NO: 8228 - RNA, 22 nt, Artificial Sequence
  Guide Sequence
gcggaacaaccccuuuuccggg

SEQ ID NO: 8229 - RNA, 22 nt, Artificial Sequence
  Guide Sequence
gcggaacugugacagggaaccu

SEQ ID NO: 8230 - RNA, 22 nt, Artificial Sequence
  Guide Sequence
gcggaaguugcuucagcacggc

SEQ ID NO: 8231 - RNA, 22 nt, Artificial Sequence
  Guide Sequence
gcgggagacggaagccccaccc

SEQ ID NO: 8232 - RNA, 22 nt, Artificial Sequence
  Guide Sequence
gcuaucaucuuccguccuucac

SEQ ID NO: 8233 - RNA, 22 nt, Artificial Sequence
  Guide Sequence
gcucgcacguggccgcggcucu

SEQ ID NO: 8234 - RNA, 22 nt, Artificial Sequence
  Guide Sequence
gcucgguucccggacggcgcug

SEQ ID NO: 8235 - RNA, 22 nt, Artificial Sequence
  Guide Sequence
gcucugaggcuucggcguccgg

SEQ ID NO: 8236 - RNA, 22 nt, Artificial Sequence
  Guide Sequence
gcugaccgggcauguccgggcc

SEQ ID NO: 8237 - RNA, 22 nt, Artificial Sequence
  Guide Sequence
gcuggcgccccacggcggaaca

SEQ ID NO: 8238 - RNA, 22 nt, Artificial Sequence
  Guide Sequence
gcuguucccuggccggaagugg

SEQ ID NO: 8239 - RNA, 22 nt, Artificial Sequence
  Guide Sequence
gcuucagcacggccggggcgag

SEQ ID NO: 8240 - RNA, 22 nt, Artificial Sequence
  Guide Sequence
ggaacaaccccuuuuccgggug

SEQ ID NO: 8241 - RNA, 22 nt, Artificial Sequence
  Guide Sequence
ggaaccuaggggaagggcgagg

SEQ ID NO: 8242 - RNA, 22 nt, Artificial Sequence
  Guide Sequence
ggaacugugacagggaaccuag

SEQ ID NO: 8243 - RNA, 22 nt, Artificial Sequence
  Guide Sequence
ggaagaaauguggcuaucaucu

SEQ ID NO: 8244 - RNA, 22 nt, Artificial Sequence
  Guide Sequence
ggaagccccacccuucucaggg

SEQ ID NO: 8245 - RNA, 22 nt, Artificial Sequence
  Guide Sequence
ggaagggcgaggaagaaaugug

SEQ ID NO: 8246 - RNA, 22 nt, Artificial Sequence
  Guide Sequence
ggaaguggcuguucccuggccg

SEQ ID NO: 8247 - RNA, 22 nt, Artificial Sequence
  Guide Sequence
ggaagugggaguaguaagggcg

SEQ ID NO: 8248 - RNA, 22 nt, Artificial Sequence
  Guide Sequence
ggaaguugcuucagcacggccg

SEQ ID NO: 8249 - RNA, 22 nt, Artificial Sequence
  Guide Sequence
ggacggcgcugaccgggcaugu

SEQ ID NO: 8250 - RNA, 22 nt, Artificial Sequence
  Guide Sequence
ggacuccggacgccccacgcac

SEQ ID NO: 8251 - RNA, 22 nt, Artificial Sequence
  Guide Sequence
ggagacggaagccccacccuuc

SEQ ID NO: 8252 - RNA, 22 nt, Artificial Sequence
  Guide Sequence
ggaguaguaagggcggaacugu

SEQ ID NO: 8253 - RNA, 22 nt, Artificial Sequence
  Guide Sequence
ggagucgcgagagcgggagacg

SEQ ID NO: 8254 - RNA, 22 nt, Artificial Sequence
  Guide Sequence
ggaugggugggccacagcuggc

SEQ ID NO: 8255 - RNA, 22 nt, Artificial Sequence
  Guide Sequence
ggcacgcgcucugaggcuucgg

SEQ ID NO: 8256 - RNA, 22 nt, Artificial Sequence
  Guide Sequence
ggcaggaugggugggccacagc

SEQ ID NO: 8257 - RNA, 22 nt, Artificial Sequence
  Guide Sequence
ggcauguccgggccugccgcuc

SEQ ID NO: 8258 - RNA, 22 nt, Artificial Sequence
  Guide Sequence
ggcccacgcucgguucccggac

SEQ ID NO: 8259 - RNA, 22 nt, Artificial Sequence
  Guide Sequence
ggcccucaggcacgcgcucuga

SEQ ID NO: 8260 - RNA, 22 nt, Artificial Sequence
  Guide Sequence
ggccggaagugggaguaguaag

SEQ ID NO: 8261 - RNA, 22 nt, Artificial Sequence
  Guide Sequence
ggcgaggaagaaauguggcuau

SEQ ID NO: 8262 - RNA, 22 nt, Artificial Sequence
  Guide Sequence
ggcgccccacggcggaacaacc

SEQ ID NO: 8263 - RNA, 22 nt, Artificial Sequence
  Guide Sequence
ggcgcugaccgggcauguccgg

SEQ ID NO: 8264 - RNA, 22 nt, Artificial Sequence
  Guide Sequence
ggcggaacaaccccuuuuccgg

SEQ ID NO: 8265 - RNA, 22 nt, Artificial Sequence
  Guide Sequence
ggcggaacugugacagggaacc

SEQ ID NO: 8266 - RNA, 22 nt, Artificial Sequence
  Guide Sequence
ggcggaaguugcuucagcacgg

SEQ ID NO: 8267 - RNA, 22 nt, Artificial Sequence
  Guide Sequence
ggcuaucaucuuccguccuuca

SEQ ID NO: 8268 - RNA, 22 nt, Artificial Sequence
  Guide Sequence
ggcuguucccuggccggaagug

SEQ ID NO: 8269 - RNA, 22 nt, Artificial Sequence
  Guide Sequence
gggaaccuaggggaagggcgag

SEQ ID NO: 8270 - RNA, 22 nt, Artificial Sequence
  Guide Sequence
gggaagggcgaggaagaaaugu

SEQ ID NO: 8271 - RNA, 22 nt, Artificial Sequence
  Guide Sequence
gggacuccggacgccccacgca

SEQ ID NO: 8272 - RNA, 22 nt, Artificial Sequence
  Guide Sequence
gggagacggaagccccacccuu

SEQ ID NO: 8273 - RNA, 22 nt, Artificial Sequence
  Guide Sequence
gggaguaguaagggcggaacug

SEQ ID NO: 8274 - RNA, 22 nt, Artificial Sequence
  Guide Sequence
gggcaggaugggugggccacag

SEQ ID NO: 8275 - RNA, 22 nt, Artificial Sequence
  Guide Sequence
gggcauguccgggccugccgcu

SEQ ID NO: 8276 - RNA, 22 nt, Artificial Sequence
  Guide Sequence
gggcccacgcucgguucccgga

SEQ ID NO: 8277 - RNA, 22 nt, Artificial Sequence
  Guide Sequence
gggcccucaggcacgcgcucug

SEQ ID NO: 8278 - RNA, 22 nt, Artificial Sequence
  Guide Sequence
gggcgaggaagaaauguggcua

SEQ ID NO: 8279 - RNA, 22 nt, Artificial Sequence
  Guide Sequence
gggcggaacugugacagggaac

SEQ ID NO: 8280 - RNA, 22 nt, Artificial Sequence
  Guide Sequence
gggcggaaguugcuucagcacg

SEQ ID NO: 8281 - RNA, 22 nt, Artificial Sequence
  Guide Sequence
ggggaagggcgaggaagaaaug

SEQ ID NO: 8282 - RNA, 22 nt, Artificial Sequence
  Guide Sequence
ggggcaggaugggugggccaca

SEQ ID NO: 8283 - RNA, 22 nt, Artificial Sequence
  Guide Sequence
ggggcccucaggcacgcgcucu

SEQ ID NO: 8284 - RNA, 22 nt, Artificial Sequence
  Guide Sequence
ggguggaaguggcuguucccug

SEQ ID NO: 8285 - RNA, 22 nt, Artificial Sequence
  Guide Sequence
gguggaaguggcuguucccugg

SEQ ID NO: 8286 - RNA, 22 nt, Artificial Sequence
  Guide Sequence
gguucccggacggcgcugaccg

SEQ ID NO: 8287 - RNA, 22 nt, Artificial Sequence
  Guide Sequence
guaagggcggaacugugacagg

SEQ ID NO: 8288 - RNA, 22 nt, Artificial Sequence
  Guide Sequence
guaguaagggcggaacugugac

SEQ ID NO: 8289 - RNA, 22 nt, Artificial Sequence
  Guide Sequence
guccuucaccgccaggagucgc

SEQ ID NO: 8290 - RNA, 22 nt, Artificial Sequence
  Guide Sequence
gucgcgagagcgggagacggaa

SEQ ID NO: 8291 - RNA, 22 nt, Artificial Sequence
  Guide Sequence
gugacagggaaccuaggggaag

SEQ ID NO: 8292 - RNA, 22 nt, Artificial Sequence
  Guide Sequence
guggaaguggcuguucccuggc

SEQ ID NO: 8293 - RNA, 22 nt, Artificial Sequence
  Guide Sequence
guggcuaucaucuuccguccuu

SEQ ID NO: 8294 - RNA, 22 nt, Artificial Sequence
  Guide Sequence
guggcuguucccuggccggaag

SEQ ID NO: 8295 - RNA, 22 nt, Artificial Sequence
  Guide Sequence
gugggaguaguaagggcggaac

SEQ ID NO: 8296 - RNA, 22 nt, Artificial Sequence
  Guide Sequence
gugggccacagcuggcgcccca

SEQ ID NO: 8297 - RNA, 22 nt, Artificial Sequence
  Guide Sequence
guucccggacggcgcugaccgg

SEQ ID NO: 8298 - RNA, 22 nt, Artificial Sequence
  Guide Sequence
guucccuggccggaagugggag

SEQ ID NO: 8299 - RNA, 22 nt, Artificial Sequence
  Guide Sequence
guugcuucagcacggccggggc

SEQ ID NO: 8300 - RNA, 22 nt, Artificial Sequence
  Guide Sequence
uaagggcggaacugugacaggg

SEQ ID NO: 8301 - RNA, 22 nt, Artificial Sequence
  Guide Sequence
uaggggaagggcgaggaagaaa

SEQ ID NO: 8302 - RNA, 22 nt, Artificial Sequence
  Guide Sequence
uaguaagggcggaacugugaca

SEQ ID NO: 8303 - RNA, 22 nt, Artificial Sequence
  Guide Sequence
uaucaucuuccguccuucaccg

SEQ ID NO: 8304 - RNA, 22 nt, Artificial Sequence
  Guide Sequence
ucaccgccaggagucgcgagag

SEQ ID NO: 8305 - RNA, 22 nt, Artificial Sequence
  Guide Sequence
ucaggcacgcgcucugaggcuu

SEQ ID NO: 8306 - RNA, 22 nt, Artificial Sequence
  Guide Sequence
ucagggcggaaguugcuucagc

SEQ ID NO: 8307 - RNA, 22 nt, Artificial Sequence
  Guide Sequence
ucaucuuccguccuucaccgcc

SEQ ID NO: 8308 - RNA, 22 nt, Artificial Sequence
  Guide Sequence
uccccagccccgggacuccgga

SEQ ID NO: 8309 - RNA, 22 nt, Artificial Sequence
  Guide Sequence
ucccuggccggaagugggagua

SEQ ID NO: 8310 - RNA, 22 nt, Artificial Sequence
  Guide Sequence
uccgggccugccgcucgcacgu

SEQ ID NO: 8311 - RNA, 22 nt, Artificial Sequence
  Guide Sequence
uccggguggaaguggcuguucc

SEQ ID NO: 8312 - RNA, 22 nt, Artificial Sequence
  Guide Sequence
uccguccuucaccgccaggagu

SEQ ID NO: 8313 - RNA, 22 nt, Artificial Sequence
  Guide Sequence
uccuucaccgccaggagucgcg

SEQ ID NO: 8314 - RNA, 22 nt, Artificial Sequence
  Guide Sequence
ucgcacguggccgcggcucuag

SEQ ID NO: 8315 - RNA, 22 nt, Artificial Sequence
  Guide Sequence
ucgcgagagcgggagacggaag

SEQ ID NO: 8316 - RNA, 22 nt, Artificial Sequence
  Guide Sequence
ucgcgcccgguccagcucggag

SEQ ID NO: 8317 - RNA, 22 nt, Artificial Sequence
  Guide Sequence
ucggggcccucaggcacgcgcu

SEQ ID NO: 8318 - RNA, 22 nt, Artificial Sequence
  Guide Sequence
ucgguucccggacggcgcugac

SEQ ID NO: 8319 - RNA, 22 nt, Artificial Sequence
  Guide Sequence
ucucagggcggaaguugcuuca

SEQ ID NO: 8320 - RNA, 22 nt, Artificial Sequence
  Guide Sequence
ucugaggcuucggcguccggcc

SEQ ID NO: 8321 - RNA, 22 nt, Artificial Sequence
  Guide Sequence
ucuuccguccuucaccgccagg

SEQ ID NO: 8322 - RNA, 22 nt, Artificial Sequence
  Guide Sequence
ugacagggaaccuaggggaagg

SEQ ID NO: 8323 - RNA, 22 nt, Artificial Sequence
  Guide Sequence
ugaccgggcauguccgggccug

SEQ ID NO: 8324 - RNA, 22 nt, Artificial Sequence
  Guide Sequence
ugcuucagcacggccggggcga

SEQ ID NO: 8325 - RNA, 22 nt, Artificial Sequence
  Guide Sequence
uggaaguggcuguucccuggcc

SEQ ID NO: 8326 - RNA, 22 nt, Artificial Sequence
  Guide Sequence
uggccggaagugggaguaguaa

SEQ ID NO: 8327 - RNA, 22 nt, Artificial Sequence
  Guide Sequence
uggcgccccacggcggaacaac

SEQ ID NO: 8328 - RNA, 22 nt, Artificial Sequence
  Guide Sequence
uggcuaucaucuuccguccuuc

SEQ ID NO: 8329 - RNA, 22 nt, Artificial Sequence
  Guide Sequence
uggcuguucccuggccggaagu

SEQ ID NO: 8330 - RNA, 22 nt, Artificial Sequence
  Guide Sequence
ugggaguaguaagggcggaacu

SEQ ID NO: 8331 - RNA, 22 nt, Artificial Sequence
  Guide Sequence
ugggccacagcuggcgccccac

SEQ ID NO: 8332 - RNA, 22 nt, Artificial Sequence
  Guide Sequence
ugggugggccacagcuggcgcc

SEQ ID NO: 8333 - RNA, 22 nt, Artificial Sequence
  Guide Sequence
uguccgggccugccgcucgcac

SEQ ID NO: 8334 - RNA, 22 nt, Artificial Sequence
  Guide Sequence
ugugacagggaaccuaggggaa

SEQ ID NO: 8335 - RNA, 22 nt, Artificial Sequence
  Guide Sequence
uguggcuaucaucuuccguccu

SEQ ID NO: 8336 - RNA, 22 nt, Artificial Sequence
  Guide Sequence
uguucccuggccggaaguggga

SEQ ID NO: 8337 - RNA, 22 nt, Artificial Sequence
  Guide Sequence
uucaccgccaggagucgcgaga

SEQ ID NO: 8338 - RNA, 22 nt, Artificial Sequence
  Guide Sequence
uucccggacggcgcugaccggg

SEQ ID NO: 8339 - RNA, 22 nt, Artificial Sequence
  Guide Sequence
uucccuggccggaagugggagu

SEQ ID NO: 8340 - RNA, 22 nt, Artificial Sequence
  Guide Sequence
uuccggguggaaguggcuguuc

SEQ ID NO: 8341 - RNA, 22 nt, Artificial Sequence
  Guide Sequence
uuccguccuucaccgccaggag

SEQ ID NO: 8342 - RNA, 22 nt, Artificial Sequence
  Guide Sequence
uucucagggcggaaguugcuuc

SEQ ID NO: 8343 - RNA, 22 nt, Artificial Sequence
  Guide Sequence
uugcuucagcacggccggggcg

SEQ ID NO: 8344 - RNA, 22 nt, Artificial Sequence
  Guide Sequence
uuuccggguggaaguggcuguu

SEQ ID NO: 8345 - RNA, 22 nt, Artificial Sequence
  Guide Sequence
uuuuccggguggaaguggcugu

SEQ ID NO: 8346 - RNA, 20 nt, Artificial Sequence
  Guide Sequence
aaaagcacgauucagucauc

SEQ ID NO: 8347 - RNA, 20 nt, Artificial Sequence
  Guide Sequence
aaacacuggggcucagaugg

SEQ ID NO: 8348 - RNA, 20 nt, Artificial Sequence
  Guide Sequence
aaaccgugguaccccccguu

SEQ ID NO: 8349 - RNA, 20 nt, Artificial Sequence
  Guide Sequence
aaacuaccccauaucccaaa

SEQ ID NO: 8350 - RNA, 20 nt, Artificial Sequence
  Guide Sequence
aaagagaggcuggaaccgga

SEQ ID NO: 8351 - RNA, 20 nt, Artificial Sequence
  Guide Sequence
aaagcacgauucagucaucu

SEQ ID NO: 8352 - RNA, 20 nt, Artificial Sequence
  Guide Sequence
aaaggagccacggaggcccc

SEQ ID NO: 8353 - RNA, 20 nt, Artificial Sequence
  Guide Sequence
aaagucaagcaugugaacac

SEQ ID NO: 8354 - RNA, 20 nt, Artificial Sequence
  Guide Sequence
aaaugcccuccccucaacac

SEQ ID NO: 8355 - RNA, 20 nt, Artificial Sequence
  Guide Sequence
aacacaacuaugcugugccc

SEQ ID NO: 8356 - RNA, 20 nt, Artificial Sequence
  Guide Sequence
aacacaagccaggccucacg

SEQ ID NO: 8357 - RNA, 20 nt, Artificial Sequence
  Guide Sequence
aacacaggccuggcagagac

SEQ ID NO: 8358 - RNA, 20 nt, Artificial Sequence
  Guide Sequence
aacacuggggcucagauggg

SEQ ID NO: 8359 - RNA, 20 nt, Artificial Sequence
  Guide Sequence
aacagagcccggccccugcg

SEQ ID NO: 8360 - RNA, 20 nt, Artificial Sequence
  Guide Sequence
aaccggaacacaagccaggc

SEQ ID NO: 8361 - RNA, 20 nt, Artificial Sequence
  Guide Sequence
aaccgugguaccccccguua

SEQ ID NO: 8362 - RNA, 20 nt, Artificial Sequence
  Guide Sequence
aacgccgggcuccggcuccu

SEQ ID NO: 8363 - RNA, 20 nt, Artificial Sequence
  Guide Sequence
aacuaccccauaucccaaau

SEQ ID NO: 8364 - RNA, 20 nt, Artificial Sequence
  Guide Sequence
aacuaugcugugcccagagu

SEQ ID NO: 8365 - RNA, 20 nt, Artificial Sequence
  Guide Sequence
aagagaggcuggaaccggaa

SEQ ID NO: 8366 - RNA, 20 nt, Artificial Sequence
  Guide Sequence
aagagcacggaccccacccc

SEQ ID NO: 8367 - RNA, 20 nt, Artificial Sequence
  Guide Sequence
aagcacgauucagucaucuc

SEQ ID NO: 8368 - RNA, 20 nt, Artificial Sequence
  Guide Sequence
aagcaugugaacacaggccu

SEQ ID NO: 8369 - RNA, 20 nt, Artificial Sequence
  Guide Sequence
aagccaggccucacgcugaa

SEQ ID NO: 8370 - RNA, 20 nt, Artificial Sequence
  Guide Sequence
aaggagccacggaggcccca

SEQ ID NO: 8371 - RNA, 20 nt, Artificial Sequence
  Guide Sequence
aaggagcucaccgacgccca

SEQ ID NO: 8372 - RNA, 20 nt, Artificial Sequence
  Guide Sequence
aaggcgacagccuccacccg

SEQ ID NO: 8373 - RNA, 20 nt, Artificial Sequence
  Guide Sequence
aagucaagcaugugaacaca

SEQ ID NO: 8374 - RNA, 20 nt, Artificial Sequence
  Guide Sequence
aauccuuucgcuccagcgca

SEQ ID NO: 8375 - RNA, 20 nt, Artificial Sequence
  Guide Sequence
aaugcccuccccucaacaca

SEQ ID NO: 8376 - RNA, 20 nt, Artificial Sequence
  Guide Sequence
acaaacuaccccauauccca

SEQ ID NO: 8377 - RNA, 20 nt, Artificial Sequence
  Guide Sequence
acaaagagaggcuggaaccg

SEQ ID NO: 8378 - RNA, 20 nt, Artificial Sequence
  Guide Sequence
acaacuaugcugugcccaga

SEQ ID NO: 8379 - RNA, 20 nt, Artificial Sequence
  Guide Sequence
acaagccaggccucacgcug

SEQ ID NO: 8380 - RNA, 20 nt, Artificial Sequence
  Guide Sequence
acacaacuaugcugugccca

SEQ ID NO: 8381 - RNA, 20 nt, Artificial Sequence
  Guide Sequence
acacaagccaggccucacgc

SEQ ID NO: 8382 - RNA, 20 nt, Artificial Sequence
  Guide Sequence
acacaggccuggcagagacg

SEQ ID NO: 8383 - RNA, 20 nt, Artificial Sequence
  Guide Sequence
acacuggggcucagaugggc

SEQ ID NO: 8384 - RNA, 20 nt, Artificial Sequence
  Guide Sequence
acagagcccggccccugcgu

SEQ ID NO: 8385 - RNA, 20 nt, Artificial Sequence
  Guide Sequence
acagccuccacccguuuuga

SEQ ID NO: 8386 - RNA, 20 nt, Artificial Sequence
  Guide Sequence
acaggccuggcagagacgac

SEQ ID NO: 8387 - RNA, 20 nt, Artificial Sequence
  Guide Sequence
accccaauccuuucgcucca

SEQ ID NO: 8388 - RNA, 20 nt, Artificial Sequence
  Guide Sequence
accccaccccaauccuuucg

SEQ ID NO: 8389 - RNA, 20 nt, Artificial Sequence
  Guide Sequence
accccauaucccaaaugccc

SEQ ID NO: 8390 - RNA, 20 nt, Artificial Sequence
  Guide Sequence
accccccguuacuucccacg

SEQ ID NO: 8391 - RNA, 20 nt, Artificial Sequence
  Guide Sequence
accgacgcccacggccucuc

SEQ ID NO: 8392 - RNA, 20 nt, Artificial Sequence
  Guide Sequence
accggaacacaagccaggcc

SEQ ID NO: 8393 - RNA, 20 nt, Artificial Sequence
  Guide Sequence
accggcaaacacuggggcuc

SEQ ID NO: 8394 - RNA, 20 nt, Artificial Sequence
  Guide Sequence
accgugguaccccccguuac

SEQ ID NO: 8395 - RNA, 20 nt, Artificial Sequence
  Guide Sequence
acgacugccaagagcacgga

SEQ ID NO: 8396 - RNA, 20 nt, Artificial Sequence
  Guide Sequence
acgauucagucaucuccaca

SEQ ID NO: 8397 - RNA, 20 nt, Artificial Sequence
  Guide Sequence
acgcccacggccucucugga

SEQ ID NO: 8398 - RNA, 20 nt, Artificial Sequence
  Guide Sequence
acgccgggcuccggcuccug

SEQ ID NO: 8399 - RNA, 20 nt, Artificial Sequence
  Guide Sequence
acgcugaaaggagccacgga

SEQ ID NO: 8400 - RNA, 20 nt, Artificial Sequence
  Guide Sequence
acggaccccaccccaauccu

SEQ ID NO: 8401 - RNA, 20 nt, Artificial Sequence
  Guide Sequence
acggccccuucaacgccggg

SEQ ID NO: 8402 - RNA, 20 nt, Artificial Sequence
  Guide Sequence
acggccucucuggaucgcac

SEQ ID NO: 8403 - RNA, 20 nt, Artificial Sequence
  Guide Sequence
acuaacagagcccggccccu

SEQ ID NO: 8404 - RNA, 20 nt, Artificial Sequence
  Guide Sequence
acuaccccauaucccaaaug

SEQ ID NO: 8405 - RNA, 20 nt, Artificial Sequence
  Guide Sequence
acuaugcugugcccagagua

SEQ ID NO: 8406 - RNA, 20 nt, Artificial Sequence
  Guide Sequence
acugccaagagcacggaccc

SEQ ID NO: 8407 - RNA, 20 nt, Artificial Sequence
  Guide Sequence
acuggggcucagaugggcag

SEQ ID NO: 8408 - RNA, 20 nt, Artificial Sequence
  Guide Sequence
acuucccacggccccuucaa

SEQ ID NO: 8409 - RNA, 20 nt, Artificial Sequence
  Guide Sequence
agaaagucaagcaugugaac

SEQ ID NO: 8410 - RNA, 20 nt, Artificial Sequence
  Guide Sequence
agacgacugccaagagcacg

SEQ ID NO: 8411 - RNA, 20 nt, Artificial Sequence
  Guide Sequence
agagacgacugccaagagca

SEQ ID NO: 8412 - RNA, 20 nt, Artificial Sequence
  Guide Sequence
agagaggcuggaaccggaac

SEQ ID NO: 8413 - RNA, 20 nt, Artificial Sequence
  Guide Sequence
agagcacggaccccacccca

SEQ ID NO: 8414 - RNA, 20 nt, Artificial Sequence
  Guide Sequence
agagcccggccccugcgugu

SEQ ID NO: 8415 - RNA, 20 nt, Artificial Sequence
  Guide Sequence
agaggcuggaaccggaacac

SEQ ID NO: 8416 - RNA, 20 nt, Artificial Sequence
  Guide Sequence
agaguacaaagagaggcugg

SEQ ID NO: 8417 - RNA, 20 nt, Artificial Sequence
  Guide Sequence
agaugggcaggccaaggcga

SEQ ID NO: 8418 - RNA, 20 nt, Artificial Sequence
  Guide Sequence
agcacgauucagucaucucc

SEQ ID NO: 8419 - RNA, 20 nt, Artificial Sequence
  Guide Sequence
agcacggaccccaccccaau

SEQ ID NO: 8420 - RNA, 20 nt, Artificial Sequence
  Guide Sequence
agcaugugaacacaggccug

SEQ ID NO: 8421 - RNA, 20 nt, Artificial Sequence
  Guide Sequence
agccacggaggccccaaaca

SEQ ID NO: 8422 - RNA, 20 nt, Artificial Sequence
  Guide Sequence
agccaggccucacgcugaaa

SEQ ID NO: 8423 - RNA, 20 nt, Artificial Sequence
  Guide Sequence
agcccggccccugcguguga

SEQ ID NO: 8424 - RNA, 20 nt, Artificial Sequence
  Guide Sequence
agccuccacccguuuugaac

SEQ ID NO: 8425 - RNA, 20 nt, Artificial Sequence
  Guide Sequence
agcgcauccuaaaccguggu

SEQ ID NO: 8426 - RNA, 20 nt, Artificial Sequence
  Guide Sequence
agcucaccgacgcccacggc

SEQ ID NO: 8427 - RNA, 20 nt, Artificial Sequence
  Guide Sequence
aggagccacggaggccccaa

SEQ ID NO: 8428 - RNA, 20 nt, Artificial Sequence
  Guide Sequence
aggagcucaccgacgcccac

SEQ ID NO: 8429 - RNA, 20 nt, Artificial Sequence
  Guide Sequence
aggauccugcgcgaccccac

SEQ ID NO: 8430 - RNA, 20 nt, Artificial Sequence
  Guide Sequence
aggccaaggcgacagccucc

SEQ ID NO: 8431 - RNA, 20 nt, Artificial Sequence
  Guide Sequence
aggccucacgcugaaaggag

SEQ ID NO: 8432 - RNA, 20 nt, Artificial Sequence
  Guide Sequence
aggccuggcagagacgacug

SEQ ID NO: 8433 - RNA, 20 nt, Artificial Sequence
  Guide Sequence
aggcgacagccuccacccgu

SEQ ID NO: 8434 - RNA, 20 nt, Artificial Sequence
  Guide Sequence
aggcuggaaccggaacacaa

SEQ ID NO: 8435 - RNA, 20 nt, Artificial Sequence
  Guide Sequence
agggagaaagucaagcaugu

SEQ ID NO: 8436 - RNA, 20 nt, Artificial Sequence
  Guide Sequence
aguacaaagagaggcuggaa

SEQ ID NO: 8437 - RNA, 20 nt, Artificial Sequence
  Guide Sequence
agucaagcaugugaacacag

SEQ ID NO: 8438 - RNA, 20 nt, Artificial Sequence
  Guide Sequence
agucaucuccacaaacuacc

SEQ ID NO: 8439 - RNA, 20 nt, Artificial Sequence
  Guide Sequence
auaucccaaaugcccucccc

SEQ ID NO: 8440 - RNA, 20 nt, Artificial Sequence
  Guide Sequence
aucccaaaugcccuccccuc

SEQ ID NO: 8441 - RNA, 20 nt, Artificial Sequence
  Guide Sequence
auccuaaaccgugguacccc

SEQ ID NO: 8442 - RNA, 20 nt, Artificial Sequence
  Guide Sequence
auccuuucgcuccagcgcau

SEQ ID NO: 8443 - RNA, 20 nt, Artificial Sequence
  Guide Sequence
aucgcacuaacagagcccgg

SEQ ID NO: 8444 - RNA, 20 nt, Artificial Sequence
  Guide Sequence
aucuccacaaacuaccccau

SEQ ID NO: 8445 - RNA, 20 nt, Artificial Sequence
  Guide Sequence
augcccuccccucaacacaa

SEQ ID NO: 8446 - RNA, 20 nt, Artificial Sequence
  Guide Sequence
augcugugcccagaguacaa

SEQ ID NO: 8447 - RNA, 20 nt, Artificial Sequence
  Guide Sequence
augggcaggccaaggcgaca

SEQ ID NO: 8448 - RNA, 20 nt, Artificial Sequence
  Guide Sequence
augugaacacaggccuggca

SEQ ID NO: 8449 - RNA, 20 nt, Artificial Sequence
  Guide Sequence
auucagucaucuccacaaac

SEQ ID NO: 8450 - RNA, 20 nt, Artificial Sequence
  Guide Sequence
caaacacuggggcucagaug

SEQ ID NO: 8451 - RNA, 20 nt, Artificial Sequence
  Guide Sequence
caaacuaccccauaucccaa

SEQ ID NO: 8452 - RNA, 20 nt, Artificial Sequence
  Guide Sequence
caaagagaggcuggaaccgg

SEQ ID NO: 8453 - RNA, 20 nt, Artificial Sequence
  Guide Sequence
caaaugcccuccccucaaca

SEQ ID NO: 8454 - RNA, 20 nt, Artificial Sequence
  Guide Sequence
caacacaacuaugcugugcc

SEQ ID NO: 8455 - RNA, 20 nt, Artificial Sequence
  Guide Sequence
caacgccgggcuccggcucc

SEQ ID NO: 8456 - RNA, 20 nt, Artificial Sequence
  Guide Sequence
caacuaugcugugcccagag

SEQ ID NO: 8457 - RNA, 20 nt, Artificial Sequence
  Guide Sequence
caagagcacggaccccaccc

SEQ ID NO: 8458 - RNA, 20 nt, Artificial Sequence
  Guide Sequence
caagcaugugaacacaggcc

SEQ ID NO: 8459 - RNA, 20 nt, Artificial Sequence
  Guide Sequence
caagccaggccucacgcuga

SEQ ID NO: 8460 - RNA, 20 nt, Artificial Sequence
  Guide Sequence
caaggcgacagccuccaccc

SEQ ID NO: 8461 - RNA, 20 nt, Artificial Sequence
  Guide Sequence
caauccuuucgcuccagcgc

SEQ ID NO: 8462 - RNA, 20 nt, Artificial Sequence
  Guide Sequence
cacaaacuaccccauauccc

SEQ ID NO: 8463 - RNA, 20 nt, Artificial Sequence
  Guide Sequence
cacaacuaugcugugcccag

SEQ ID NO: 8464 - RNA, 20 nt, Artificial Sequence
  Guide Sequence
cacaagccaggccucacgcu

SEQ ID NO: 8465 - RNA, 20 nt, Artificial Sequence
  Guide Sequence
cacaggccuggcagagacga

SEQ ID NO: 8466 - RNA, 20 nt, Artificial Sequence
  Guide Sequence
caccccaauccuuucgcucc

SEQ ID NO: 8467 - RNA, 20 nt, Artificial Sequence
  Guide Sequence
caccgacgcccacggccucu

SEQ ID NO: 8468 - RNA, 20 nt, Artificial Sequence
  Guide Sequence
cacgauucagucaucuccac

SEQ ID NO: 8469 - RNA, 20 nt, Artificial Sequence
  Guide Sequence
cacgcugaaaggagccacgg

SEQ ID NO: 8470 - RNA, 20 nt, Artificial Sequence
  Guide Sequence
cacggaccccaccccaaucc

SEQ ID NO: 8471 - RNA, 20 nt, Artificial Sequence
  Guide Sequence
cacggccccuucaacgccgg

SEQ ID NO: 8472 - RNA, 20 nt, Artificial Sequence
  Guide Sequence
cacggccucucuggaucgca

SEQ ID NO: 8473 - RNA, 20 nt, Artificial Sequence
  Guide Sequence
cacuaacagagcccggcccc

SEQ ID NO: 8474 - RNA, 20 nt, Artificial Sequence
  Guide Sequence
cacuggggcucagaugggca

SEQ ID NO: 8475 - RNA, 20 nt, Artificial Sequence
  Guide Sequence
cagagacgacugccaagagc

SEQ ID NO: 8476 - RNA, 20 nt, Artificial Sequence
  Guide Sequence
cagagcccggccccugcgug

SEQ ID NO: 8477 - RNA, 20 nt, Artificial Sequence
  Guide Sequence
cagaguacaaagagaggcug

SEQ ID NO: 8478 - RNA, 20 nt, Artificial Sequence
  Guide Sequence
cagaugggcaggccaaggcg

SEQ ID NO: 8479 - RNA, 20 nt, Artificial Sequence
  Guide Sequence
cagccuccacccguuuugaa

SEQ ID NO: 8480 - RNA, 20 nt, Artificial Sequence
  Guide Sequence
cagcgcauccuaaaccgugg

SEQ ID NO: 8481 - RNA, 20 nt, Artificial Sequence
  Guide Sequence
caggccaaggcgacagccuc

SEQ ID NO: 8482 - RNA, 20 nt, Artificial Sequence
  Guide Sequence
caggccucacgcugaaagga

SEQ ID NO: 8483 - RNA, 20 nt, Artificial Sequence
  Guide Sequence
caggccuggcagagacgacu

SEQ ID NO: 8484 - RNA, 20 nt, Artificial Sequence
  Guide Sequence
cagucaucuccacaaacuac

SEQ ID NO: 8485 - RNA, 20 nt, Artificial Sequence
  Guide Sequence
cauaucccaaaugcccuccc

SEQ ID NO: 8486 - RNA, 20 nt, Artificial Sequence
  Guide Sequence
cauccuaaaccgugguaccc

SEQ ID NO: 8487 - RNA, 20 nt, Artificial Sequence
  Guide Sequence
caucuccacaaacuacccca

SEQ ID NO: 8488 - RNA, 20 nt, Artificial Sequence
  Guide Sequence
caugugaacacaggccuggc

SEQ ID NO: 8489 - RNA, 20 nt, Artificial Sequence
  Guide Sequence
ccaaaugcccuccccucaac

SEQ ID NO: 8490 - RNA, 20 nt, Artificial Sequence
  Guide Sequence
ccaagagcacggaccccacc

SEQ ID NO: 8491 - RNA, 20 nt, Artificial Sequence
  Guide Sequence
ccaaggcgacagccuccacc

SEQ ID NO: 8492 - RNA, 20 nt, Artificial Sequence
  Guide Sequence
ccaauccuuucgcuccagcg

SEQ ID NO: 8493 - RNA, 20 nt, Artificial Sequence
  Guide Sequence
ccacaaacuaccccauaucc

SEQ ID NO: 8494 - RNA, 20 nt, Artificial Sequence
  Guide Sequence
ccaccccaauccuuucgcuc

SEQ ID NO: 8495 - RNA, 20 nt, Artificial Sequence
  Guide Sequence
ccacccguuuugaaccucag

SEQ ID NO: 8496 - RNA, 20 nt, Artificial Sequence
  Guide Sequence
ccacggaggccccaaacaag

SEQ ID NO: 8497 - RNA, 20 nt, Artificial Sequence
  Guide Sequence
ccacggccccuucaacgccg

SEQ ID NO: 8498 - RNA, 20 nt, Artificial Sequence
  Guide Sequence
ccacggccucucuggaucgc

SEQ ID NO: 8499 - RNA, 20 nt, Artificial Sequence
  Guide Sequence
ccagaguacaaagagaggcu

SEQ ID NO: 8500 - RNA, 20 nt, Artificial Sequence
  Guide Sequence
ccagcgcauccuaaaccgug

SEQ ID NO: 8501 - RNA, 20 nt, Artificial Sequence
  Guide Sequence
ccaggccucacgcugaaagg

SEQ ID NO: 8502 - RNA, 20 nt, Artificial Sequence
  Guide Sequence
ccauaucccaaaugcccucc

SEQ ID NO: 8503 - RNA, 20 nt, Artificial Sequence
  Guide Sequence
cccaaaugcccuccccucaa

SEQ ID NO: 8504 - RNA, 20 nt, Artificial Sequence
  Guide Sequence
cccaauccuuucgcuccagc

SEQ ID NO: 8505 - RNA, 20 nt, Artificial Sequence
  Guide Sequence
cccaccccaauccuuucgcu

SEQ ID NO: 8506 - RNA, 20 nt, Artificial Sequence
  Guide Sequence
cccacggccccuucaacgcc

SEQ ID NO: 8507 - RNA, 20 nt, Artificial Sequence
  Guide Sequence
cccacggccucucuggaucg

SEQ ID NO: 8508 - RNA, 20 nt, Artificial Sequence
  Guide Sequence
cccagaguacaaagagaggc

SEQ ID NO: 8509 - RNA, 20 nt, Artificial Sequence
  Guide Sequence
cccauaucccaaaugcccuc

SEQ ID NO: 8510 - RNA, 20 nt, Artificial Sequence
  Guide Sequence
ccccaauccuuucgcuccag

SEQ ID NO: 8511 - RNA, 20 nt, Artificial Sequence
  Guide Sequence
ccccaccccaauccuuucgc

SEQ ID NO: 8512 - RNA, 20 nt, Artificial Sequence
  Guide Sequence
ccccauaucccaaaugcccu

SEQ ID NO: 8513 - RNA, 20 nt, Artificial Sequence
  Guide Sequence
ccccccguuacuucccacgg

SEQ ID NO: 8514 - RNA, 20 nt, Artificial Sequence
  Guide Sequence
cccccguuacuucccacggc

SEQ ID NO: 8515 - RNA, 20 nt, Artificial Sequence
  Guide Sequence
ccccguuacuucccacggcc

SEQ ID NO: 8516 - RNA, 20 nt, Artificial Sequence
  Guide Sequence
ccccucaacacaacuaugcu

SEQ ID NO: 8517 - RNA, 20 nt, Artificial Sequence
  Guide Sequence
ccccugcgugugaggauccu

SEQ ID NO: 8518 - RNA, 20 nt, Artificial Sequence
  Guide Sequence
ccccuucaacgccgggcucc

SEQ ID NO: 8519 - RNA, 20 nt, Artificial Sequence
  Guide Sequence
cccggccccugcgugugagg

SEQ ID NO: 8520 - RNA, 20 nt, Artificial Sequence
  Guide Sequence
cccguuacuucccacggccc

SEQ ID NO: 8521 - RNA, 20 nt, Artificial Sequence
  Guide Sequence
cccucaacacaacuaugcug

SEQ ID NO: 8522 - RNA, 20 nt, Artificial Sequence
  Guide Sequence
cccuccccucaacacaacua

SEQ ID NO: 8523 - RNA, 20 nt, Artificial Sequence
  Guide Sequence
cccugcgugugaggauccug

SEQ ID NO: 8524 - RNA, 20 nt, Artificial Sequence
  Guide Sequence
cccuucaacgccgggcuccg

SEQ ID NO: 8525 - RNA, 20 nt, Artificial Sequence
  Guide Sequence
ccgacgcccacggccucucu

SEQ ID NO: 8526 - RNA, 20 nt, Artificial Sequence
  Guide Sequence
ccggaacacaagccaggccu

SEQ ID NO: 8527 - RNA, 20 nt, Artificial Sequence
  Guide Sequence
ccggcaaacacuggggcuca

SEQ ID NO: 8528 - RNA, 20 nt, Artificial Sequence
  Guide Sequence
ccggccccugcgugugagga

SEQ ID NO: 8529 - RNA, 20 nt, Artificial Sequence
  Guide Sequence
ccggcuccugcgggucugaa

SEQ ID NO: 8530 - RNA, 20 nt, Artificial Sequence
  Guide Sequence
ccgugguaccccccguuacu

SEQ ID NO: 8531 - RNA, 20 nt, Artificial Sequence
  Guide Sequence
ccguuacuucccacggcccc

SEQ ID NO: 8532 - RNA, 20 nt, Artificial Sequence
  Guide Sequence
ccuaaaccgugguacccccc

SEQ ID NO: 8533 - RNA, 20 nt, Artificial Sequence
  Guide Sequence
ccucaacacaacuaugcugu

SEQ ID NO: 8534 - RNA, 20 nt, Artificial Sequence
  Guide Sequence
ccucacgcugaaaggagcca

SEQ ID NO: 8535 - RNA, 20 nt, Artificial Sequence
  Guide Sequence
ccuccacccguuuugaaccu

SEQ ID NO: 8536 - RNA, 20 nt, Artificial Sequence
  Guide Sequence
ccuccccucaacacaacuau

SEQ ID NO: 8537 - RNA, 20 nt, Artificial Sequence
  Guide Sequence
ccucucuggaucgcacuaac

SEQ ID NO: 8538 - RNA, 20 nt, Artificial Sequence
  Guide Sequence
ccugcgggucugaaggagcu

SEQ ID NO: 8539 - RNA, 20 nt, Artificial Sequence
  Guide Sequence
ccugcgugugaggauccugc

SEQ ID NO: 8540 - RNA, 20 nt, Artificial Sequence
  Guide Sequence
ccuggcagagacgacugcca

SEQ ID NO: 8541 - RNA, 20 nt, Artificial Sequence
  Guide Sequence
ccuucaacgccgggcuccgg

SEQ ID NO: 8542 - RNA, 20 nt, Artificial Sequence
  Guide Sequence
ccuuucgcuccagcgcaucc

SEQ ID NO: 8543 - RNA, 20 nt, Artificial Sequence
  Guide Sequence
cgacagccuccacccguuuu

SEQ ID NO: 8544 - RNA, 20 nt, Artificial Sequence
  Guide Sequence
cgacgcccacggccucucug

SEQ ID NO: 8545 - RNA, 20 nt, Artificial Sequence
  Guide Sequence
cgacugccaagagcacggac

SEQ ID NO: 8546 - RNA, 20 nt, Artificial Sequence
  Guide Sequence
cgauucagucaucuccacaa

SEQ ID NO: 8547 - RNA, 20 nt, Artificial Sequence
  Guide Sequence
cgcacuaacagagcccggcc

SEQ ID NO: 8548 - RNA, 20 nt, Artificial Sequence
  Guide Sequence
cgcauccuaaaccgugguac

SEQ ID NO: 8549 - RNA, 20 nt, Artificial Sequence
  Guide Sequence
cgcccacggccucucuggau

SEQ ID NO: 8550 - RNA, 20 nt, Artificial Sequence
  Guide Sequence
cgcuccagcgcauccuaaac

SEQ ID NO: 8551 - RNA, 20 nt, Artificial Sequence
  Guide Sequence
cgcugaaaggagccacggag

SEQ ID NO: 8552 - RNA, 20 nt, Artificial Sequence
  Guide Sequence
cggaacacaagccaggccuc

SEQ ID NO: 8553 - RNA, 20 nt, Artificial Sequence
  Guide Sequence
cggaccccaccccaauccuu

SEQ ID NO: 8554 - RNA, 20 nt, Artificial Sequence
  Guide Sequence
cggcaaacacuggggcucag

SEQ ID NO: 8555 - RNA, 20 nt, Artificial Sequence
  Guide Sequence
cggccccugcgugugaggau

SEQ ID NO: 8556 - RNA, 20 nt, Artificial Sequence
  Guide Sequence
cggccccuucaacgccgggc

SEQ ID NO: 8557 - RNA, 20 nt, Artificial Sequence
  Guide Sequence
cggccucucuggaucgcacu

SEQ ID NO: 8558 - RNA, 20 nt, Artificial Sequence
  Guide Sequence
cggcuccugcgggucugaag

SEQ ID NO: 8559 - RNA, 20 nt, Artificial Sequence
  Guide Sequence
cgggucugaaggagcucacc

SEQ ID NO: 8560 - RNA, 20 nt, Artificial Sequence
  Guide Sequence
cgugguaccccccguuacuu

SEQ ID NO: 8561 - RNA, 20 nt, Artificial Sequence
  Guide Sequence
cgugugaggauccugcgcga

SEQ ID NO: 8562 - RNA, 20 nt, Artificial Sequence
  Guide Sequence
cguuacuucccacggccccu

SEQ ID NO: 8563 - RNA, 20 nt, Artificial Sequence
  Guide Sequence
cguuuugaaccucagucccc

SEQ ID NO: 8564 - RNA, 20 nt, Artificial Sequence
  Guide Sequence
cuaaaccgugguaccccccg

SEQ ID NO: 8565 - RNA, 20 nt, Artificial Sequence
  Guide Sequence
cuaacagagcccggccccug

SEQ ID NO: 8566 - RNA, 20 nt, Artificial Sequence
  Guide Sequence
cuaccccauaucccaaaugc

SEQ ID NO: 8567 - RNA, 20 nt, Artificial Sequence
  Guide Sequence
cuaugcugugcccagaguac

SEQ ID NO: 8568 - RNA, 20 nt, Artificial Sequence
  Guide Sequence
cucaacacaacuaugcugug

SEQ ID NO: 8569 - RNA, 20 nt, Artificial Sequence
  Guide Sequence
cucaccgacgcccacggccu

SEQ ID NO: 8570 - RNA, 20 nt, Artificial Sequence
  Guide Sequence
cucacgcugaaaggagccac

SEQ ID NO: 8571 - RNA, 20 nt, Artificial Sequence
  Guide Sequence
cucagaugggcaggccaagg

SEQ ID NO: 8572 - RNA, 20 nt, Artificial Sequence
  Guide Sequence
cuccacaaacuaccccauau

SEQ ID NO: 8573 - RNA, 20 nt, Artificial Sequence
  Guide Sequence
cuccacccguuuugaaccuc

SEQ ID NO: 8574 - RNA, 20 nt, Artificial Sequence
  Guide Sequence
cuccagcgcauccuaaaccg

SEQ ID NO: 8575 - RNA, 20 nt, Artificial Sequence
  Guide Sequence
cuccccucaacacaacuaug

SEQ ID NO: 8576 - RNA, 20 nt, Artificial Sequence
  Guide Sequence
cuccggcuccugcgggucug

SEQ ID NO: 8577 - RNA, 20 nt, Artificial Sequence
  Guide Sequence
cuccugcgggucugaaggag

SEQ ID NO: 8578 - RNA, 20 nt, Artificial Sequence
  Guide Sequence
cucucuggaucgcacuaaca

SEQ ID NO: 8579 - RNA, 20 nt, Artificial Sequence
  Guide Sequence
cucuggaucgcacuaacaga

SEQ ID NO: 8580 - RNA, 20 nt, Artificial Sequence
  Guide Sequence
cugaaaggagccacggaggc

SEQ ID NO: 8581 - RNA, 20 nt, Artificial Sequence
  Guide Sequence
cugaaggagcucaccgacgc

SEQ ID NO: 8582 - RNA, 20 nt, Artificial Sequence
  Guide Sequence
cugagggagaaagucaagca

SEQ ID NO: 8583 - RNA, 20 nt, Artificial Sequence
  Guide Sequence
cugccaagagcacggacccc

SEQ ID NO: 8584 - RNA, 20 nt, Artificial Sequence
  Guide Sequence
cugcgggucugaaggagcuc

SEQ ID NO: 8585 - RNA, 20 nt, Artificial Sequence
  Guide Sequence
cugcgugugaggauccugcg

SEQ ID NO: 8586 - RNA, 20 nt, Artificial Sequence
  Guide Sequence
cuggaaccggaacacaagcc

SEQ ID NO: 8587 - RNA, 20 nt, Artificial Sequence
  Guide Sequence
cuggaucgcacuaacagagc

SEQ ID NO: 8588 - RNA, 20 nt, Artificial Sequence
  Guide Sequence
cuggcagagacgacugccaa

SEQ ID NO: 8589 - RNA, 20 nt, Artificial Sequence
  Guide Sequence
cuggggcucagaugggcagg

SEQ ID NO: 8590 - RNA, 20 nt, Artificial Sequence
  Guide Sequence
cugugcccagaguacaaaga

SEQ ID NO: 8591 - RNA, 20 nt, Artificial Sequence
  Guide Sequence
cuucaacgccgggcuccggc

SEQ ID NO: 8592 - RNA, 20 nt, Artificial Sequence
  Guide Sequence
cuucccacggccccuucaac

SEQ ID NO: 8593 - RNA, 20 nt, Artificial Sequence
  Guide Sequence
cuuucgcuccagcgcauccu

SEQ ID NO: 8594 - RNA, 20 nt, Artificial Sequence
  Guide Sequence
gaaaagcacgauucagucau

SEQ ID NO: 8595 - RNA, 20 nt, Artificial Sequence
  Guide Sequence
gaaaggagccacggaggccc

SEQ ID NO: 8596 - RNA, 20 nt, Artificial Sequence
  Guide Sequence
gaaagucaagcaugugaaca

SEQ ID NO: 8597 - RNA, 20 nt, Artificial Sequence
  Guide Sequence
gaacacaagccaggccucac

SEQ ID NO: 8598 - RNA, 20 nt, Artificial Sequence
  Guide Sequence
gaacacaggccuggcagaga

SEQ ID NO: 8599 - RNA, 20 nt, Artificial Sequence
  Guide Sequence
gaaccggaacacaagccagg

SEQ ID NO: 8600 - RNA, 20 nt, Artificial Sequence
  Guide Sequence
gaaggagcucaccgacgccc

SEQ ID NO: 8601 - RNA, 20 nt, Artificial Sequence
  Guide Sequence
gacagccuccacccguuuug

SEQ ID NO: 8602 - RNA, 20 nt, Artificial Sequence
  Guide Sequence
gaccccaccccaauccuuuc

SEQ ID NO: 8603 - RNA, 20 nt, Artificial Sequence
  Guide Sequence
gacgacugccaagagcacgg

SEQ ID NO: 8604 - RNA, 20 nt, Artificial Sequence
  Guide Sequence
gacgcccacggccucucugg

SEQ ID NO: 8605 - RNA, 20 nt, Artificial Sequence
  Guide Sequence
gacugccaagagcacggacc

SEQ ID NO: 8606 - RNA, 20 nt, Artificial Sequence
  Guide Sequence
gagaaagucaagcaugugaa

SEQ ID NO: 8607 - RNA, 20 nt, Artificial Sequence
  Guide Sequence
gagacgacugccaagagcac

SEQ ID NO: 8608 - RNA, 20 nt, Artificial Sequence
  Guide Sequence
gagaggcuggaaccggaaca

SEQ ID NO: 8609 - RNA, 20 nt, Artificial Sequence
  Guide Sequence
gagcacggaccccaccccaa

SEQ ID NO: 8610 - RNA, 20 nt, Artificial Sequence
  Guide Sequence
gagccacggaggccccaaac

SEQ ID NO: 8611 - RNA, 20 nt, Artificial Sequence
  Guide Sequence
gagcccggccccugcgugug

SEQ ID NO: 8612 - RNA, 20 nt, Artificial Sequence
  Guide Sequence
gagcucaccgacgcccacgg

SEQ ID NO: 8613 - RNA, 20 nt, Artificial Sequence
  Guide Sequence
gaggauccugcgcgacccca

SEQ ID NO: 8614 - RNA, 20 nt, Artificial Sequence
  Guide Sequence
gaggcuggaaccggaacaca

SEQ ID NO: 8615 - RNA, 20 nt, Artificial Sequence
  Guide Sequence
gagggagaaagucaagcaug

SEQ ID NO: 8616 - RNA, 20 nt, Artificial Sequence
  Guide Sequence
gaguacaaagagaggcugga

SEQ ID NO: 8617 - RNA, 20 nt, Artificial Sequence
  Guide Sequence
gaucgcacuaacagagcccg

SEQ ID NO: 8618 - RNA, 20 nt, Artificial Sequence
  Guide Sequence
gaugggcaggccaaggcgac

SEQ ID NO: 8619 - RNA, 20 nt, Artificial Sequence
  Guide Sequence
gauucagucaucuccacaaa

SEQ ID NO: 8620 - RNA, 20 nt, Artificial Sequence
  Guide Sequence
gcaaacacuggggcucagau

SEQ ID NO: 8621 - RNA, 20 nt, Artificial Sequence
  Guide Sequence
gcacgauucagucaucucca

SEQ ID NO: 8622 - RNA, 20 nt, Artificial Sequence
  Guide Sequence
gcacggaccccaccccaauc

SEQ ID NO: 8623 - RNA, 20 nt, Artificial Sequence
  Guide Sequence
gcacuaacagagcccggccc

SEQ ID NO: 8624 - RNA, 20 nt, Artificial Sequence
  Guide Sequence
gcagagacgacugccaagag

SEQ ID NO: 8625 - RNA, 20 nt, Artificial Sequence
  Guide Sequence
gcaggccaaggcgacagccu

SEQ ID NO: 8626 - RNA, 20 nt, Artificial Sequence
  Guide Sequence
gcauccuaaaccgugguacc

SEQ ID NO: 8627 - RNA, 20 nt, Artificial Sequence
  Guide Sequence
gcaugugaacacaggccugg

SEQ ID NO: 8628 - RNA, 20 nt, Artificial Sequence
  Guide Sequence
gccaagagcacggaccccac

SEQ ID NO: 8629 - RNA, 20 nt, Artificial Sequence
  Guide Sequence
gccaaggcgacagccuccac

SEQ ID NO: 8630 - RNA, 20 nt, Artificial Sequence
  Guide Sequence
gccacggaggccccaaacaa

SEQ ID NO: 8631 - RNA, 20 nt, Artificial Sequence
  Guide Sequence
gccaggccucacgcugaaag

SEQ ID NO: 8632 - RNA, 20 nt, Artificial Sequence
  Guide Sequence
gcccacggccucucuggauc

SEQ ID NO: 8633 - RNA, 20 nt, Artificial Sequence
  Guide Sequence
gcccagaguacaaagagagg

SEQ ID NO: 8634 - RNA, 20 nt, Artificial Sequence
  Guide Sequence
gccccugcgugugaggaucc

SEQ ID NO: 8635 - RNA, 20 nt, Artificial Sequence
  Guide Sequence
gccccuucaacgccgggcuc

SEQ ID NO: 8636 - RNA, 20 nt, Artificial Sequence
  Guide Sequence
gcccggccccugcgugugag

SEQ ID NO: 8637 - RNA, 20 nt, Artificial Sequence
  Guide Sequence
gcccuccccucaacacaacu

SEQ ID NO: 8638 - RNA, 20 nt, Artificial Sequence
  Guide Sequence
gccucacgcugaaaggagcc

SEQ ID NO: 8639 - RNA, 20 nt, Artificial Sequence
  Guide Sequence
gccuccacccguuuugaacc

SEQ ID NO: 8640 - RNA, 20 nt, Artificial Sequence
  Guide Sequence
gccucucuggaucgcacuaa

SEQ ID NO: 8641 - RNA, 20 nt, Artificial Sequence
  Guide Sequence
gccuggcagagacgacugcc

SEQ ID NO: 8642 - RNA, 20 nt, Artificial Sequence
  Guide Sequence
gcgacagccuccacccguuu

SEQ ID NO: 8643 - RNA, 20 nt, Artificial Sequence
  Guide Sequence
gcgcauccuaaaccguggua

SEQ ID NO: 8644 - RNA, 20 nt, Artificial Sequence
  Guide Sequence
gcgggucugaaggagcucac

SEQ ID NO: 8645 - RNA, 20 nt, Artificial Sequence
  Guide Sequence
gcgugugaggauccugcgcg

SEQ ID NO: 8646 - RNA, 20 nt, Artificial Sequence
  Guide Sequence
gcucaccgacgcccacggcc

SEQ ID NO: 8647 - RNA, 20 nt, Artificial Sequence
  Guide Sequence
gcucagaugggcaggccaag

SEQ ID NO: 8648 - RNA, 20 nt, Artificial Sequence
  Guide Sequence
gcuccagcgcauccuaaacc

SEQ ID NO: 8649 - RNA, 20 nt, Artificial Sequence
  Guide Sequence
gcuccggcuccugcgggucu

SEQ ID NO: 8650 - RNA, 20 nt, Artificial Sequence
  Guide Sequence
gcuccugcgggucugaagga

SEQ ID NO: 8651 - RNA, 20 nt, Artificial Sequence
  Guide Sequence
gcugaaaggagccacggagg

SEQ ID NO: 8652 - RNA, 20 nt, Artificial Sequence
  Guide Sequence
gcuggaaccggaacacaagc

SEQ ID NO: 8653 - RNA, 20 nt, Artificial Sequence
  Guide Sequence
gcugugcccagaguacaaag

SEQ ID NO: 8654 - RNA, 20 nt, Artificial Sequence
  Guide Sequence
ggaaaagcacgauucaguca

SEQ ID NO: 8655 - RNA, 20 nt, Artificial Sequence
  Guide Sequence
ggaacacaagccaggccuca

SEQ ID NO: 8656 - RNA, 20 nt, Artificial Sequence
  Guide Sequence
ggaaccggaacacaagccag

SEQ ID NO: 8657 - RNA, 20 nt, Artificial Sequence
  Guide Sequence
ggaccccaccccaauccuuu

SEQ ID NO: 8658 - RNA, 20 nt, Artificial Sequence
  Guide Sequence
ggagaaagucaagcauguga

SEQ ID NO: 8659 - RNA, 20 nt, Artificial Sequence
  Guide Sequence
ggagccacggaggccccaaa

SEQ ID NO: 8660 - RNA, 20 nt, Artificial Sequence
  Guide Sequence
ggagcucaccgacgcccacg

SEQ ID NO: 8661 - RNA, 20 nt, Artificial Sequence
  Guide Sequence
ggaucgcacuaacagagccc

SEQ ID NO: 8662 - RNA, 20 nt, Artificial Sequence
  Guide Sequence
ggcaaacacuggggcucaga

SEQ ID NO: 8663 - RNA, 20 nt, Artificial Sequence
  Guide Sequence
ggcagagacgacugccaaga

SEQ ID NO: 8664 - RNA, 20 nt, Artificial Sequence
  Guide Sequence
ggcaggccaaggcgacagcc

SEQ ID NO: 8665 - RNA, 20 nt, Artificial Sequence
  Guide Sequence
ggccaaggcgacagccucca

SEQ ID NO: 8666 - RNA, 20 nt, Artificial Sequence
  Guide Sequence
ggccccugcgugugaggauc

SEQ ID NO: 8667 - RNA, 20 nt, Artificial Sequence
  Guide Sequence
ggccccuucaacgccgggcu

SEQ ID NO: 8668 - RNA, 20 nt, Artificial Sequence
  Guide Sequence
ggccucacgcugaaaggagc

SEQ ID NO: 8669 - RNA, 20 nt, Artificial Sequence
  Guide Sequence
ggccucucuggaucgcacua

SEQ ID NO: 8670 - RNA, 20 nt, Artificial Sequence
  Guide Sequence
ggccuggcagagacgacugc

SEQ ID NO: 8671 - RNA, 20 nt, Artificial Sequence
  Guide Sequence
ggcgacagccuccacccguu

SEQ ID NO: 8672 - RNA, 20 nt, Artificial Sequence
  Guide Sequence
ggcucagaugggcaggccaa

SEQ ID NO: 8673 - RNA, 20 nt, Artificial Sequence
  Guide Sequence
ggcuccggcuccugcggguc

SEQ ID NO: 8674 - RNA, 20 nt, Artificial Sequence
  Guide Sequence
ggcuccugcgggucugaagg

SEQ ID NO: 8675 - RNA, 20 nt, Artificial Sequence
  Guide Sequence
ggcuggaaccggaacacaag

SEQ ID NO: 8676 - RNA, 20 nt, Artificial Sequence
  Guide Sequence
gggaaaagcacgauucaguc

SEQ ID NO: 8677 - RNA, 20 nt, Artificial Sequence
  Guide Sequence
gggagaaagucaagcaugug

SEQ ID NO: 8678 - RNA, 20 nt, Artificial Sequence
  Guide Sequence
gggcaggccaaggcgacagc

SEQ ID NO: 8679 - RNA, 20 nt, Artificial Sequence
  Guide Sequence
gggcucagaugggcaggcca

SEQ ID NO: 8680 - RNA, 20 nt, Artificial Sequence
  Guide Sequence
gggcuccggcuccugcgggu

SEQ ID NO: 8681 - RNA, 20 nt, Artificial Sequence
  Guide Sequence
ggggcucagaugggcaggcc

SEQ ID NO: 8682 - RNA, 20 nt, Artificial Sequence
  Guide Sequence
gggucugaaggagcucaccg

SEQ ID NO: 8683 - RNA, 20 nt, Artificial Sequence
  Guide Sequence
gguaccccccguuacuuccc

SEQ ID NO: 8684 - RNA, 20 nt, Artificial Sequence
  Guide Sequence
ggucugaaggagcucaccga

SEQ ID NO: 8685 - RNA, 20 nt, Artificial Sequence
  Guide Sequence
guacaaagagaggcuggaac

SEQ ID NO: 8686 - RNA, 20 nt, Artificial Sequence
  Guide Sequence
guaccccccguuacuuccca

SEQ ID NO: 8687 - RNA, 20 nt, Artificial Sequence
  Guide Sequence
gucaagcaugugaacacagg

SEQ ID NO: 8688 - RNA, 20 nt, Artificial Sequence
  Guide Sequence
gucaucuccacaaacuaccc

SEQ ID NO: 8689 - RNA, 20 nt, Artificial Sequence
  Guide Sequence
gucugaaggagcucaccgac

SEQ ID NO: 8690 - RNA, 20 nt, Artificial Sequence
  Guide Sequence
gugaacacaggccuggcaga

SEQ ID NO: 8691 - RNA, 20 nt, Artificial Sequence
  Guide Sequence
gugaggauccugcgcgaccc

SEQ ID NO: 8692 - RNA, 20 nt, Artificial Sequence
  Guide Sequence
gugcccagaguacaaagaga

SEQ ID NO: 8693 - RNA, 20 nt, Artificial Sequence
  Guide Sequence
gugguaccccccguuacuuc

SEQ ID NO: 8694 - RNA, 20 nt, Artificial Sequence
  Guide Sequence
gugugaggauccugcgcgac

SEQ ID NO: 8695 - RNA, 20 nt, Artificial Sequence
  Guide Sequence
guuacuucccacggccccuu

SEQ ID NO: 8696 - RNA, 20 nt, Artificial Sequence
  Guide Sequence
guuuugaaccucagucccca

SEQ ID NO: 8697 - RNA, 20 nt, Artificial Sequence
  Guide Sequence
uaaaccgugguaccccccgu

SEQ ID NO: 8698 - RNA, 20 nt, Artificial Sequence
  Guide Sequence
uaacagagcccggccccugc

SEQ ID NO: 8699 - RNA, 20 nt, Artificial Sequence
  Guide Sequence
uacaaagagaggcuggaacc

SEQ ID NO: 8700 - RNA, 20 nt, Artificial Sequence
  Guide Sequence
uaccccauaucccaaaugcc

SEQ ID NO: 8701 - RNA, 20 nt, Artificial Sequence
  Guide Sequence
uaccccccguuacuucccac

SEQ ID NO: 8702 - RNA, 20 nt, Artificial Sequence
  Guide Sequence
uacuucccacggccccuuca

SEQ ID NO: 8703 - RNA, 20 nt, Artificial Sequence
  Guide Sequence
uaucccaaaugcccuccccu

SEQ ID NO: 8704 - RNA, 20 nt, Artificial Sequence
  Guide Sequence
uaugcugugcccagaguaca

SEQ ID NO: 8705 - RNA, 20 nt, Artificial Sequence
  Guide Sequence
ucaacacaacuaugcugugc

SEQ ID NO: 8706 - RNA, 20 nt, Artificial Sequence
  Guide Sequence
ucaacgccgggcuccggcuc

SEQ ID NO: 8707 - RNA, 20 nt, Artificial Sequence
  Guide Sequence
ucaagcaugugaacacaggc

SEQ ID NO: 8708 - RNA, 20 nt, Artificial Sequence
  Guide Sequence
ucaccgacgcccacggccuc

SEQ ID NO: 8709 - RNA, 20 nt, Artificial Sequence
  Guide Sequence
ucacgcugaaaggagccacg

SEQ ID NO: 8710 - RNA, 20 nt, Artificial Sequence
  Guide Sequence
ucagaugggcaggccaaggc

SEQ ID NO: 8711 - RNA, 20 nt, Artificial Sequence
  Guide Sequence
ucagucaucuccacaaacua

SEQ ID NO: 8712 - RNA, 20 nt, Artificial Sequence
  Guide Sequence
ucaucuccacaaacuacccc

SEQ ID NO: 8713 - RNA, 20 nt, Artificial Sequence
  Guide Sequence
uccacaaacuaccccauauc

SEQ ID NO: 8714 - RNA, 20 nt, Artificial Sequence
  Guide Sequence
uccacccguuuugaaccuca

SEQ ID NO: 8715 - RNA, 20 nt, Artificial Sequence
  Guide Sequence
uccagcgcauccuaaaccgu

SEQ ID NO: 8716 - RNA, 20 nt, Artificial Sequence
  Guide Sequence
ucccaaaugcccuccccuca

SEQ ID NO: 8717 - RNA, 20 nt, Artificial Sequence
  Guide Sequence
ucccacggccccuucaacgc

SEQ ID NO: 8718 - RNA, 20 nt, Artificial Sequence
  Guide Sequence
uccccucaacacaacuaugc

SEQ ID NO: 8719 - RNA, 20 nt, Artificial Sequence
  Guide Sequence
uccggcuccugcgggucuga

SEQ ID NO: 8720 - RNA, 20 nt, Artificial Sequence
  Guide Sequence
uccuaaaccgugguaccccc

SEQ ID NO: 8721 - RNA, 20 nt, Artificial Sequence
  Guide Sequence
uccugcgggucugaaggagc

SEQ ID NO: 8722 - RNA, 20 nt, Artificial Sequence
  Guide Sequence
uccuuucgcuccagcgcauc

SEQ ID NO: 8723 - RNA, 20 nt, Artificial Sequence
  Guide Sequence
ucgcacuaacagagcccggc

SEQ ID NO: 8724 - RNA, 20 nt, Artificial Sequence
  Guide Sequence
ucgcuccagcgcauccuaaa

SEQ ID NO: 8725 - RNA, 20 nt, Artificial Sequence
  Guide Sequence
ucuccacaaacuaccccaua

SEQ ID NO: 8726 - RNA, 20 nt, Artificial Sequence
  Guide Sequence
ucucuggaucgcacuaacag

SEQ ID NO: 8727 - RNA, 20 nt, Artificial Sequence
  Guide Sequence
ucugaaggagcucaccgacg

SEQ ID NO: 8728 - RNA, 20 nt, Artificial Sequence
  Guide Sequence
ucuggaucgcacuaacagag

SEQ ID NO: 8729 - RNA, 20 nt, Artificial Sequence
  Guide Sequence
ugaaaggagccacggaggcc

SEQ ID NO: 8730 - RNA, 20 nt, Artificial Sequence
  Guide Sequence
ugaacacaggccuggcagag

SEQ ID NO: 8731 - RNA, 20 nt, Artificial Sequence
  Guide Sequence
ugaaggagcucaccgacgcc

SEQ ID NO: 8732 - RNA, 20 nt, Artificial Sequence
  Guide Sequence
ugaggauccugcgcgacccc

SEQ ID NO: 8733 - RNA, 20 nt, Artificial Sequence
  Guide Sequence
ugagggagaaagucaagcau

SEQ ID NO: 8734 - RNA, 20 nt, Artificial Sequence
  Guide Sequence
ugccaagagcacggacccca

SEQ ID NO: 8735 - RNA, 20 nt, Artificial Sequence
  Guide Sequence
ugcccagaguacaaagagag

SEQ ID NO: 8736 - RNA, 20 nt, Artificial Sequence
  Guide Sequence
ugcccuccccucaacacaac

SEQ ID NO: 8737 - RNA, 20 nt, Artificial Sequence
  Guide Sequence
ugcgggucugaaggagcuca

SEQ ID NO: 8738 - RNA, 20 nt, Artificial Sequence
  Guide Sequence
ugcgugugaggauccugcgc

SEQ ID NO: 8739 - RNA, 20 nt, Artificial Sequence
  Guide Sequence
ugcugugcccagaguacaaa

SEQ ID NO: 8740 - RNA, 20 nt, Artificial Sequence
  Guide Sequence
uggaaccggaacacaagcca

SEQ ID NO: 8741 - RNA, 20 nt, Artificial Sequence
  Guide Sequence
uggaucgcacuaacagagcc

SEQ ID NO: 8742 - RNA, 20 nt, Artificial Sequence
  Guide Sequence
uggcagagacgacugccaag

SEQ ID NO: 8743 - RNA, 20 nt, Artificial Sequence
  Guide Sequence
ugggcaggccaaggcgacag

SEQ ID NO: 8744 - RNA, 20 nt, Artificial Sequence
  Guide Sequence
uggggcucagaugggcaggc

SEQ ID NO: 8745 - RNA, 20 nt, Artificial Sequence
  Guide Sequence
ugguaccccccguuacuucc

SEQ ID NO: 8746 - RNA, 20 nt, Artificial Sequence
  Guide Sequence
ugugaacacaggccuggcag

SEQ ID NO: 8747 - RNA, 20 nt, Artificial Sequence
  Guide Sequence
ugugaggauccugcgcgacc

SEQ ID NO: 8748 - RNA, 20 nt, Artificial Sequence
  Guide Sequence
ugugcccagaguacaaagag

SEQ ID NO: 8749 - RNA, 20 nt, Artificial Sequence
  Guide Sequence
uuacuucccacggccccuuc

SEQ ID NO: 8750 - RNA, 20 nt, Artificial Sequence
  Guide Sequence
uucaacgccgggcuccggcu

SEQ ID NO: 8751 - RNA, 20 nt, Artificial Sequence
  Guide Sequence
uucagucaucuccacaaacu

SEQ ID NO: 8752 - RNA, 20 nt, Artificial Sequence
  Guide Sequence
uucccacggccccuucaacg

SEQ ID NO: 8753 - RNA, 20 nt, Artificial Sequence
  Guide Sequence
uucgcuccagcgcauccuaa

SEQ ID NO: 8754 - RNA, 20 nt, Artificial Sequence
  Guide Sequence
uugaaccucaguccccaaac

SEQ ID NO: 8755 - RNA, 20 nt, Artificial Sequence
  Guide Sequence
uuucgcuccagcgcauccua

SEQ ID NO: 8756 - RNA, 20 nt, Artificial Sequence
  Guide Sequence
uuugaaccucaguccccaaa

SEQ ID NO: 8757 - RNA, 20 nt, Artificial Sequence
  Guide Sequence
uuuugaaccucaguccccaa

SEQ ID NO: 8758 - RNA, 21 nt, Artificial Sequence
  Guide Sequence
aaaagcacgauucagucaucu

SEQ ID NO: 8759 - RNA, 21 nt, Artificial Sequence
  Guide Sequence
aaacacuggggcucagauggg

SEQ ID NO: 8760 - RNA, 21 nt, Artificial Sequence
  Guide Sequence
aaaccgugguaccccccguua

SEQ ID NO: 8761 - RNA, 21 nt, Artificial Sequence
  Guide Sequence
aaacuaccccauaucccaaau

SEQ ID NO: 8762 - RNA, 21 nt, Artificial Sequence
  Guide Sequence
aaagagaggcuggaaccggaa

SEQ ID NO: 8763 - RNA, 21 nt, Artificial Sequence
  Guide Sequence
aaagcacgauucagucaucuc

SEQ ID NO: 8764 - RNA, 21 nt, Artificial Sequence
  Guide Sequence
aaaggagccacggaggcccca

SEQ ID NO: 8765 - RNA, 21 nt, Artificial Sequence
  Guide Sequence
aaagucaagcaugugaacaca

SEQ ID NO: 8766 - RNA, 21 nt, Artificial Sequence
  Guide Sequence
aaaugcccuccccucaacaca

SEQ ID NO: 8767 - RNA, 21 nt, Artificial Sequence
  Guide Sequence
aacacaacuaugcugugccca

SEQ ID NO: 8768 - RNA, 21 nt, Artificial Sequence
  Guide Sequence
aacacaagccaggccucacgc

SEQ ID NO: 8769 - RNA, 21 nt, Artificial Sequence
  Guide Sequence
aacacaggccuggcagagacg

SEQ ID NO: 8770 - RNA, 21 nt, Artificial Sequence
  Guide Sequence
aacacuggggcucagaugggc

SEQ ID NO: 8771 - RNA, 21 nt, Artificial Sequence
  Guide Sequence
aacagagcccggccccugcgu

SEQ ID NO: 8772 - RNA, 21 nt, Artificial Sequence
  Guide Sequence
aaccggaacacaagccaggcc

SEQ ID NO: 8773 - RNA, 21 nt, Artificial Sequence
  Guide Sequence
aaccgugguaccccccguuac

SEQ ID NO: 8774 - RNA, 21 nt, Artificial Sequence
  Guide Sequence
aacgccgggcuccggcuccug

SEQ ID NO: 8775 - RNA, 21 nt, Artificial Sequence
  Guide Sequence
aacuaccccauaucccaaaug

SEQ ID NO: 8776 - RNA, 21 nt, Artificial Sequence
  Guide Sequence
aacuaugcugugcccagagua

SEQ ID NO: 8777 - RNA, 21 nt, Artificial Sequence
  Guide Sequence
aagagaggcuggaaccggaac

SEQ ID NO: 8778 - RNA, 21 nt, Artificial Sequence
  Guide Sequence
aagagcacggaccccacccca

SEQ ID NO: 8779 - RNA, 21 nt, Artificial Sequence
  Guide Sequence
aagcacgauucagucaucucc

SEQ ID NO: 8780 - RNA, 21 nt, Artificial Sequence
  Guide Sequence
aagcaugugaacacaggccug

SEQ ID NO: 8781 - RNA, 21 nt, Artificial Sequence
  Guide Sequence
aagccaggccucacgcugaaa

SEQ ID NO: 8782 - RNA, 21 nt, Artificial Sequence
  Guide Sequence
aaggagccacggaggccccaa

SEQ ID NO: 8783 - RNA, 21 nt, Artificial Sequence
  Guide Sequence
aaggagcucaccgacgcccac

SEQ ID NO: 8784 - RNA, 21 nt, Artificial Sequence
  Guide Sequence
aaggcgacagccuccacccgu

SEQ ID NO: 8785 - RNA, 21 nt, Artificial Sequence
  Guide Sequence
aagucaagcaugugaacacag

SEQ ID NO: 8786 - RNA, 21 nt, Artificial Sequence
  Guide Sequence
aauccuuucgcuccagcgcau

SEQ ID NO: 8787 - RNA, 21 nt, Artificial Sequence
  Guide Sequence
aaugcccuccccucaacacaa

SEQ ID NO: 8788 - RNA, 21 nt, Artificial Sequence
  Guide Sequence
acaaacuaccccauaucccaa

SEQ ID NO: 8789 - RNA, 21 nt, Artificial Sequence
  Guide Sequence
acaaagagaggcuggaaccgg

SEQ ID NO: 8790 - RNA, 21 nt, Artificial Sequence
  Guide Sequence
acaacuaugcugugcccagag

SEQ ID NO: 8791 - RNA, 21 nt, Artificial Sequence
  Guide Sequence
acaagccaggccucacgcuga

SEQ ID NO: 8792 - RNA, 21 nt, Artificial Sequence
  Guide Sequence
acacaacuaugcugugcccag

SEQ ID NO: 8793 - RNA, 21 nt, Artificial Sequence
  Guide Sequence
acacaagccaggccucacgcu

SEQ ID NO: 8794 - RNA, 21 nt, Artificial Sequence
  Guide Sequence
acacaggccuggcagagacga

SEQ ID NO: 8795 - RNA, 21 nt, Artificial Sequence
  Guide Sequence
acacuggggcucagaugggca

SEQ ID NO: 8796 - RNA, 21 nt, Artificial Sequence
  Guide Sequence
acagagcccggccccugcgug

SEQ ID NO: 8797 - RNA, 21 nt, Artificial Sequence
  Guide Sequence
acagccuccacccguuuugaa

SEQ ID NO: 8798 - RNA, 21 nt, Artificial Sequence
  Guide Sequence
acaggccuggcagagacgacu

SEQ ID NO: 8799 - RNA, 21 nt, Artificial Sequence
  Guide Sequence
accccaauccuuucgcuccag

SEQ ID NO: 8800 - RNA, 21 nt, Artificial Sequence
  Guide Sequence
accccaccccaauccuuucgc

SEQ ID NO: 8801 - RNA, 21 nt, Artificial Sequence
  Guide Sequence
accccauaucccaaaugcccu

SEQ ID NO: 8802 - RNA, 21 nt, Artificial Sequence
  Guide Sequence
accccccguuacuucccacgg

SEQ ID NO: 8803 - RNA, 21 nt, Artificial Sequence
  Guide Sequence
accgacgcccacggccucucu

SEQ ID NO: 8804 - RNA, 21 nt, Artificial Sequence
  Guide Sequence
accggaacacaagccaggccu

SEQ ID NO: 8805 - RNA, 21 nt, Artificial Sequence
  Guide Sequence
accggcaaacacuggggcuca

SEQ ID NO: 8806 - RNA, 21 nt, Artificial Sequence
  Guide Sequence
accgugguaccccccguuacu

SEQ ID NO: 8807 - RNA, 21 nt, Artificial Sequence
  Guide Sequence
acgacugccaagagcacggac

SEQ ID NO: 8808 - RNA, 21 nt, Artificial Sequence
  Guide Sequence
acgauucagucaucuccacaa

SEQ ID NO: 8809 - RNA, 21 nt, Artificial Sequence
  Guide Sequence
acgcccacggccucucuggau

SEQ ID NO: 8810 - RNA, 21 nt, Artificial Sequence
  Guide Sequence
acgcugaaaggagccacggag

SEQ ID NO: 8811 - RNA, 21 nt, Artificial Sequence
  Guide Sequence
acggaccccaccccaauccuu

SEQ ID NO: 8812 - RNA, 21 nt, Artificial Sequence
  Guide Sequence
acggccccuucaacgccgggc

SEQ ID NO: 8813 - RNA, 21 nt, Artificial Sequence
  Guide Sequence
acggccucucuggaucgcacu

SEQ ID NO: 8814 - RNA, 21 nt, Artificial Sequence
  Guide Sequence
acuaacagagcccggccccug

SEQ ID NO: 8815 - RNA, 21 nt, Artificial Sequence
  Guide Sequence
acuaccccauaucccaaaugc

SEQ ID NO: 8816 - RNA, 21 nt, Artificial Sequence
  Guide Sequence
acuaugcugugcccagaguac

SEQ ID NO: 8817 - RNA, 21 nt, Artificial Sequence
  Guide Sequence
acugccaagagcacggacccc

SEQ ID NO: 8818 - RNA, 21 nt, Artificial Sequence
  Guide Sequence
acuggggcucagaugggcagg

SEQ ID NO: 8819 - RNA, 21 nt, Artificial Sequence
  Guide Sequence
acuucccacggccccuucaac

SEQ ID NO: 8820 - RNA, 21 nt, Artificial Sequence
  Guide Sequence
agaaagucaagcaugugaaca

SEQ ID NO: 8821 - RNA, 21 nt, Artificial Sequence
  Guide Sequence
agacgacugccaagagcacgg

SEQ ID NO: 8822 - RNA, 21 nt, Artificial Sequence
  Guide Sequence
agagacgacugccaagagcac

SEQ ID NO: 8823 - RNA, 21 nt, Artificial Sequence
  Guide Sequence
agagaggcuggaaccggaaca

SEQ ID NO: 8824 - RNA, 21 nt, Artificial Sequence
  Guide Sequence
agagcacggaccccaccccaa

SEQ ID NO: 8825 - RNA, 21 nt, Artificial Sequence
  Guide Sequence
agagcccggccccugcgugug

SEQ ID NO: 8826 - RNA, 21 nt, Artificial Sequence
  Guide Sequence
agaggcuggaaccggaacaca

SEQ ID NO: 8827 - RNA, 21 nt, Artificial Sequence
  Guide Sequence
agaguacaaagagaggcugga

SEQ ID NO: 8828 - RNA, 21 nt, Artificial Sequence
  Guide Sequence
agaugggcaggccaaggcgac

SEQ ID NO: 8829 - RNA, 21 nt, Artificial Sequence
  Guide Sequence
agcacgauucagucaucucca

SEQ ID NO: 8830 - RNA, 21 nt, Artificial Sequence
  Guide Sequence
agcacggaccccaccccaauc

SEQ ID NO: 8831 - RNA, 21 nt, Artificial Sequence
  Guide Sequence
agcaugugaacacaggccugg

SEQ ID NO: 8832 - RNA, 21 nt, Artificial Sequence
  Guide Sequence
agccacggaggccccaaacaa

SEQ ID NO: 8833 - RNA, 21 nt, Artificial Sequence
  Guide Sequence
agccaggccucacgcugaaag

SEQ ID NO: 8834 - RNA, 21 nt, Artificial Sequence
  Guide Sequence
agcccggccccugcgugugag

SEQ ID NO: 8835 - RNA, 21 nt, Artificial Sequence
  Guide Sequence
agccuccacccguuuugaacc

SEQ ID NO: 8836 - RNA, 21 nt, Artificial Sequence
  Guide Sequence
agcgcauccuaaaccguggua

SEQ ID NO: 8837 - RNA, 21 nt, Artificial Sequence
  Guide Sequence
agcucaccgacgcccacggcc

SEQ ID NO: 8838 - RNA, 21 nt, Artificial Sequence
  Guide Sequence
aggagccacggaggccccaaa

SEQ ID NO: 8839 - RNA, 21 nt, Artificial Sequence
  Guide Sequence
aggagcucaccgacgcccacg

SEQ ID NO: 8840 - RNA, 21 nt, Artificial Sequence
  Guide Sequence
aggccaaggcgacagccucca

SEQ ID NO: 8841 - RNA, 21 nt, Artificial Sequence
  Guide Sequence
aggccucacgcugaaaggagc

SEQ ID NO: 8842 - RNA, 21 nt, Artificial Sequence
  Guide Sequence
aggccuggcagagacgacugc

SEQ ID NO: 8843 - RNA, 21 nt, Artificial Sequence
  Guide Sequence
aggcgacagccuccacccguu

SEQ ID NO: 8844 - RNA, 21 nt, Artificial Sequence
  Guide Sequence
aggcuggaaccggaacacaag

SEQ ID NO: 8845 - RNA, 21 nt, Artificial Sequence
  Guide Sequence
agggagaaagucaagcaugug

SEQ ID NO: 8846 - RNA, 21 nt, Artificial Sequence
  Guide Sequence
aguacaaagagaggcuggaac

SEQ ID NO: 8847 - RNA, 21 nt, Artificial Sequence
  Guide Sequence
agucaagcaugugaacacagg

SEQ ID NO: 8848 - RNA, 21 nt, Artificial Sequence
  Guide Sequence
agucaucuccacaaacuaccc

SEQ ID NO: 8849 - RNA, 21 nt, Artificial Sequence
  Guide Sequence
auaucccaaaugcccuccccu

SEQ ID NO: 8850 - RNA, 21 nt, Artificial Sequence
  Guide Sequence
aucccaaaugcccuccccuca

SEQ ID NO: 8851 - RNA, 21 nt, Artificial Sequence
  Guide Sequence
auccuaaaccgugguaccccc

SEQ ID NO: 8852 - RNA, 21 nt, Artificial Sequence
  Guide Sequence
auccuuucgcuccagcgcauc

SEQ ID NO: 8853 - RNA, 21 nt, Artificial Sequence
  Guide Sequence
aucgcacuaacagagcccggc

SEQ ID NO: 8854 - RNA, 21 nt, Artificial Sequence
  Guide Sequence
aucuccacaaacuaccccaua

SEQ ID NO: 8855 - RNA, 21 nt, Artificial Sequence
  Guide Sequence
augcccuccccucaacacaac

SEQ ID NO: 8856 - RNA, 21 nt, Artificial Sequence
  Guide Sequence
augcugugcccagaguacaaa

SEQ ID NO: 8857 - RNA, 21 nt, Artificial Sequence
  Guide Sequence
augggcaggccaaggcgacag

SEQ ID NO: 8858 - RNA, 21 nt, Artificial Sequence
  Guide Sequence
augugaacacaggccuggcag

SEQ ID NO: 8859 - RNA, 21 nt, Artificial Sequence
  Guide Sequence
auucagucaucuccacaaacu

SEQ ID NO: 8860 - RNA, 21 nt, Artificial Sequence
  Guide Sequence
caaacacuggggcucagaugg

SEQ ID NO: 8861 - RNA, 21 nt, Artificial Sequence
  Guide Sequence
caaacuaccccauaucccaaa

SEQ ID NO: 8862 - RNA, 21 nt, Artificial Sequence
  Guide Sequence
caaagagaggcuggaaccgga

SEQ ID NO: 8863 - RNA, 21 nt, Artificial Sequence
  Guide Sequence
caaaugcccuccccucaacac

SEQ ID NO: 8864 - RNA, 21 nt, Artificial Sequence
  Guide Sequence
caacacaacuaugcugugccc

SEQ ID NO: 8865 - RNA, 21 nt, Artificial Sequence
  Guide Sequence
caacgccgggcuccggcuccu

SEQ ID NO: 8866 - RNA, 21 nt, Artificial Sequence
  Guide Sequence
caacuaugcugugcccagagu

SEQ ID NO: 8867 - RNA, 21 nt, Artificial Sequence
  Guide Sequence
caagagcacggaccccacccc

SEQ ID NO: 8868 - RNA, 21 nt, Artificial Sequence
  Guide Sequence
caagcaugugaacacaggccu

SEQ ID NO: 8869 - RNA, 21 nt, Artificial Sequence
  Guide Sequence
caagccaggccucacgcugaa

SEQ ID NO: 8870 - RNA, 21 nt, Artificial Sequence
  Guide Sequence
caaggcgacagccuccacccg

SEQ ID NO: 8871 - RNA, 21 nt, Artificial Sequence
  Guide Sequence
caauccuuucgcuccagcgca

SEQ ID NO: 8872 - RNA, 21 nt, Artificial Sequence
  Guide Sequence
cacaaacuaccccauauccca

SEQ ID NO: 8873 - RNA, 21 nt, Artificial Sequence
  Guide Sequence
cacaacuaugcugugcccaga

SEQ ID NO: 8874 - RNA, 21 nt, Artificial Sequence
  Guide Sequence
cacaagccaggccucacgcug

SEQ ID NO: 8875 - RNA, 21 nt, Artificial Sequence
  Guide Sequence
cacaggccuggcagagacgac

SEQ ID NO: 8876 - RNA, 21 nt, Artificial Sequence
  Guide Sequence
caccccaauccuuucgcucca

SEQ ID NO: 8877 - RNA, 21 nt, Artificial Sequence
  Guide Sequence
caccgacgcccacggccucuc

SEQ ID NO: 8878 - RNA, 21 nt, Artificial Sequence
  Guide Sequence
cacgauucagucaucuccaca

SEQ ID NO: 8879 - RNA, 21 nt, Artificial Sequence
  Guide Sequence
cacgcugaaaggagccacgga

SEQ ID NO: 8880 - RNA, 21 nt, Artificial Sequence
  Guide Sequence
cacggaccccaccccaauccu

SEQ ID NO: 8881 - RNA, 21 nt, Artificial Sequence
  Guide Sequence
cacggccccuucaacgccggg

SEQ ID NO: 8882 - RNA, 21 nt, Artificial Sequence
  Guide Sequence
cacggccucucuggaucgcac

SEQ ID NO: 8883 - RNA, 21 nt, Artificial Sequence
  Guide Sequence
cacuaacagagcccggccccu

SEQ ID NO: 8884 - RNA, 21 nt, Artificial Sequence
  Guide Sequence
cacuggggcucagaugggcag

SEQ ID NO: 8885 - RNA, 21 nt, Artificial Sequence
  Guide Sequence
cagagacgacugccaagagca

SEQ ID NO: 8886 - RNA, 21 nt, Artificial Sequence
  Guide Sequence
cagagcccggccccugcgugu

SEQ ID NO: 8887 - RNA, 21 nt, Artificial Sequence
  Guide Sequence
cagaguacaaagagaggcugg

SEQ ID NO: 8888 - RNA, 21 nt, Artificial Sequence
  Guide Sequence
cagaugggcaggccaaggcga

SEQ ID NO: 8889 - RNA, 21 nt, Artificial Sequence
  Guide Sequence
cagccuccacccguuuugaac

SEQ ID NO: 8890 - RNA, 21 nt, Artificial Sequence
  Guide Sequence
cagcgcauccuaaaccguggu

SEQ ID NO: 8891 - RNA, 21 nt, Artificial Sequence
  Guide Sequence
caggccaaggcgacagccucc

SEQ ID NO: 8892 - RNA, 21 nt, Artificial Sequence
  Guide Sequence
caggccucacgcugaaaggag

SEQ ID NO: 8893 - RNA, 21 nt, Artificial Sequence
  Guide Sequence
caggccuggcagagacgacug

SEQ ID NO: 8894 - RNA, 21 nt, Artificial Sequence
  Guide Sequence
cagucaucuccacaaacuacc

SEQ ID NO: 8895 - RNA, 21 nt, Artificial Sequence
  Guide Sequence
cauaucccaaaugcccucccc

SEQ ID NO: 8896 - RNA, 21 nt, Artificial Sequence
  Guide Sequence
cauccuaaaccgugguacccc

SEQ ID NO: 8897 - RNA, 21 nt, Artificial Sequence
  Guide Sequence
caucuccacaaacuaccccau

SEQ ID NO: 8898 - RNA, 21 nt, Artificial Sequence
  Guide Sequence
caugugaacacaggccuggca

SEQ ID NO: 8899 - RNA, 21 nt, Artificial Sequence
  Guide Sequence
ccaaaugcccuccccucaaca

SEQ ID NO: 8900 - RNA, 21 nt, Artificial Sequence
  Guide Sequence
ccaagagcacggaccccaccc

SEQ ID NO: 8901 - RNA, 21 nt, Artificial Sequence
  Guide Sequence
ccaaggcgacagccuccaccc

SEQ ID NO: 8902 - RNA, 21 nt, Artificial Sequence
  Guide Sequence
ccaauccuuucgcuccagcgc

SEQ ID NO: 8903 - RNA, 21 nt, Artificial Sequence
  Guide Sequence
ccacaaacuaccccauauccc

SEQ ID NO: 8904 - RNA, 21 nt, Artificial Sequence
  Guide Sequence
ccaccccaauccuuucgcucc

SEQ ID NO: 8905 - RNA, 21 nt, Artificial Sequence
  Guide Sequence
ccacggccccuucaacgccgg

SEQ ID NO: 8906 - RNA, 21 nt, Artificial Sequence
  Guide Sequence
ccacggccucucuggaucgca

SEQ ID NO: 8907 - RNA, 21 nt, Artificial Sequence
  Guide Sequence
ccagaguacaaagagaggcug

SEQ ID NO: 8908 - RNA, 21 nt, Artificial Sequence
  Guide Sequence
ccagcgcauccuaaaccgugg

SEQ ID NO: 8909 - RNA, 21 nt, Artificial Sequence
  Guide Sequence
ccaggccucacgcugaaagga

SEQ ID NO: 8910 - RNA, 21 nt, Artificial Sequence
  Guide Sequence
ccauaucccaaaugcccuccc

SEQ ID NO: 8911 - RNA, 21 nt, Artificial Sequence
  Guide Sequence
cccaaaugcccuccccucaac

SEQ ID NO: 8912 - RNA, 21 nt, Artificial Sequence
  Guide Sequence
cccaauccuuucgcuccagcg

SEQ ID NO: 8913 - RNA, 21 nt, Artificial Sequence
  Guide Sequence
cccaccccaauccuuucgcuc

SEQ ID NO: 8914 - RNA, 21 nt, Artificial Sequence
  Guide Sequence
cccacggccccuucaacgccg

SEQ ID NO: 8915 - RNA, 21 nt, Artificial Sequence
  Guide Sequence
cccacggccucucuggaucgc

SEQ ID NO: 8916 - RNA, 21 nt, Artificial Sequence
  Guide Sequence
cccagaguacaaagagaggcu

SEQ ID NO: 8917 - RNA, 21 nt, Artificial Sequence
  Guide Sequence
cccauaucccaaaugcccucc

SEQ ID NO: 8918 - RNA, 21 nt, Artificial Sequence
  Guide Sequence
ccccaauccuuucgcuccagc

SEQ ID NO: 8919 - RNA, 21 nt, Artificial Sequence
  Guide Sequence
ccccaccccaauccuuucgcu

SEQ ID NO: 8920 - RNA, 21 nt, Artificial Sequence
  Guide Sequence
ccccauaucccaaaugcccuc

SEQ ID NO: 8921 - RNA, 21 nt, Artificial Sequence
  Guide Sequence
ccccccguuacuucccacggc

SEQ ID NO: 8922 - RNA, 21 nt, Artificial Sequence
  Guide Sequence
cccccguuacuucccacggcc

SEQ ID NO: 8923 - RNA, 21 nt, Artificial Sequence
  Guide Sequence
ccccguuacuucccacggccc

SEQ ID NO: 8924 - RNA, 21 nt, Artificial Sequence
  Guide Sequence
ccccucaacacaacuaugcug

SEQ ID NO: 8925 - RNA, 21 nt, Artificial Sequence
  Guide Sequence
ccccugcgugugaggauccug

SEQ ID NO: 8926 - RNA, 21 nt, Artificial Sequence
  Guide Sequence
ccccuucaacgccgggcuccg

SEQ ID NO: 8927 - RNA, 21 nt, Artificial Sequence
  Guide Sequence
cccggccccugcgugugagga

SEQ ID NO: 8928 - RNA, 21 nt, Artificial Sequence
  Guide Sequence
cccguuacuucccacggcccc

SEQ ID NO: 8929 - RNA, 21 nt, Artificial Sequence
  Guide Sequence
cccucaacacaacuaugcugu

SEQ ID NO: 8930 - RNA, 21 nt, Artificial Sequence
  Guide Sequence
cccuccccucaacacaacuau

SEQ ID NO: 8931 - RNA, 21 nt, Artificial Sequence
  Guide Sequence
cccugcgugugaggauccugc

SEQ ID NO: 8932 - RNA, 21 nt, Artificial Sequence
  Guide Sequence
cccuucaacgccgggcuccgg

SEQ ID NO: 8933 - RNA, 21 nt, Artificial Sequence
  Guide Sequence
ccgacgcccacggccucucug

SEQ ID NO: 8934 - RNA, 21 nt, Artificial Sequence
  Guide Sequence
ccggaacacaagccaggccuc

SEQ ID NO: 8935 - RNA, 21 nt, Artificial Sequence
  Guide Sequence
ccggcaaacacuggggcucag

SEQ ID NO: 8936 - RNA, 21 nt, Artificial Sequence
  Guide Sequence
ccggccccugcgugugaggau

SEQ ID NO: 8937 - RNA, 21 nt, Artificial Sequence
  Guide Sequence
ccggcuccugcgggucugaag

SEQ ID NO: 8938 - RNA, 21 nt, Artificial Sequence
  Guide Sequence
ccgugguaccccccguuacuu

SEQ ID NO: 8939 - RNA, 21 nt, Artificial Sequence
  Guide Sequence
ccguuacuucccacggccccu

SEQ ID NO: 8940 - RNA, 21 nt, Artificial Sequence
  Guide Sequence
ccguuuugaaccucagucccc

SEQ ID NO: 8941 - RNA, 21 nt, Artificial Sequence
  Guide Sequence
ccuaaaccgugguaccccccg

SEQ ID NO: 8942 - RNA, 21 nt, Artificial Sequence
  Guide Sequence
ccucaacacaacuaugcugug

SEQ ID NO: 8943 - RNA, 21 nt, Artificial Sequence
  Guide Sequence
ccucacgcugaaaggagccac

SEQ ID NO: 8944 - RNA, 21 nt, Artificial Sequence
  Guide Sequence
ccuccacccguuuugaaccuc

SEQ ID NO: 8945 - RNA, 21 nt, Artificial Sequence
  Guide Sequence
ccuccccucaacacaacuaug

SEQ ID NO: 8946 - RNA, 21 nt, Artificial Sequence
  Guide Sequence
ccucucuggaucgcacuaaca

SEQ ID NO: 8947 - RNA, 21 nt, Artificial Sequence
  Guide Sequence
ccugcgggucugaaggagcuc

SEQ ID NO: 8948 - RNA, 21 nt, Artificial Sequence
  Guide Sequence
ccugcgugugaggauccugcg

SEQ ID NO: 8949 - RNA, 21 nt, Artificial Sequence
  Guide Sequence
ccuggcagagacgacugccaa

SEQ ID NO: 8950 - RNA, 21 nt, Artificial Sequence
  Guide Sequence
ccuucaacgccgggcuccggc

SEQ ID NO: 8951 - RNA, 21 nt, Artificial Sequence
  Guide Sequence
ccuuucgcuccagcgcauccu

SEQ ID NO: 8952 - RNA, 21 nt, Artificial Sequence
  Guide Sequence
cgacagccuccacccguuuug

SEQ ID NO: 8953 - RNA, 21 nt, Artificial Sequence
  Guide Sequence
cgacgcccacggccucucugg

SEQ ID NO: 8954 - RNA, 21 nt, Artificial Sequence
  Guide Sequence
cgacugccaagagcacggacc

SEQ ID NO: 8955 - RNA, 21 nt, Artificial Sequence
  Guide Sequence
cgauucagucaucuccacaaa

SEQ ID NO: 8956 - RNA, 21 nt, Artificial Sequence
  Guide Sequence
cgcacuaacagagcccggccc

SEQ ID NO: 8957 - RNA, 21 nt, Artificial Sequence
  Guide Sequence
cgcauccuaaaccgugguacc

SEQ ID NO: 8958 - RNA, 21 nt, Artificial Sequence
  Guide Sequence
cgcccacggccucucuggauc

SEQ ID NO: 8959 - RNA, 21 nt, Artificial Sequence
  Guide Sequence
cgcuccagcgcauccuaaacc

SEQ ID NO: 8960 - RNA, 21 nt, Artificial Sequence
  Guide Sequence
cgcugaaaggagccacggagg

SEQ ID NO: 8961 - RNA, 21 nt, Artificial Sequence
  Guide Sequence
cggaacacaagccaggccuca

SEQ ID NO: 8962 - RNA, 21 nt, Artificial Sequence
  Guide Sequence
cggaccccaccccaauccuuu

SEQ ID NO: 8963 - RNA, 21 nt, Artificial Sequence
  Guide Sequence
cggcaaacacuggggcucaga

SEQ ID NO: 8964 - RNA, 21 nt, Artificial Sequence
  Guide Sequence
cggccccugcgugugaggauc

SEQ ID NO: 8965 - RNA, 21 nt, Artificial Sequence
  Guide Sequence
cggccccuucaacgccgggcu

SEQ ID NO: 8966 - RNA, 21 nt, Artificial Sequence
  Guide Sequence
cggccucucuggaucgcacua

SEQ ID NO: 8967 - RNA, 21 nt, Artificial Sequence
  Guide Sequence
cggcuccugcgggucugaagg

SEQ ID NO: 8968 - RNA, 21 nt, Artificial Sequence
  Guide Sequence
cgggucugaaggagcucaccg

SEQ ID NO: 8969 - RNA, 21 nt, Artificial Sequence
  Guide Sequence
cgugguaccccccguuacuuc

SEQ ID NO: 8970 - RNA, 21 nt, Artificial Sequence
  Guide Sequence
cgugugaggauccugcgcgac

SEQ ID NO: 8971 - RNA, 21 nt, Artificial Sequence
  Guide Sequence
cguuacuucccacggccccuu

SEQ ID NO: 8972 - RNA, 21 nt, Artificial Sequence
  Guide Sequence
cguuuugaaccucagucccca

SEQ ID NO: 8973 - RNA, 21 nt, Artificial Sequence
  Guide Sequence
cuaaaccgugguaccccccgu

SEQ ID NO: 8974 - RNA, 21 nt, Artificial Sequence
  Guide Sequence
cuaacagagcccggccccugc

SEQ ID NO: 8975 - RNA, 21 nt, Artificial Sequence
  Guide Sequence
cuaccccauaucccaaaugcc

SEQ ID NO: 8976 - RNA, 21 nt, Artificial Sequence
  Guide Sequence
cuaugcugugcccagaguaca

SEQ ID NO: 8977 - RNA, 21 nt, Artificial Sequence
  Guide Sequence
cucaacacaacuaugcugugc

SEQ ID NO: 8978 - RNA, 21 nt, Artificial Sequence
  Guide Sequence
cucaccgacgcccacggccuc

SEQ ID NO: 8979 - RNA, 21 nt, Artificial Sequence
  Guide Sequence
cucacgcugaaaggagccacg

SEQ ID NO: 8980 - RNA, 21 nt, Artificial Sequence
  Guide Sequence
cucagaugggcaggccaaggc

SEQ ID NO: 8981 - RNA, 21 nt, Artificial Sequence
  Guide Sequence
cuccacaaacuaccccauauc

SEQ ID NO: 8982 - RNA, 21 nt, Artificial Sequence
  Guide Sequence
cuccacccguuuugaaccuca

SEQ ID NO: 8983 - RNA, 21 nt, Artificial Sequence
  Guide Sequence
cuccagcgcauccuaaaccgu

SEQ ID NO: 8984 - RNA, 21 nt, Artificial Sequence
  Guide Sequence
cuccccucaacacaacuaugc

SEQ ID NO: 8985 - RNA, 21 nt, Artificial Sequence
  Guide Sequence
cuccggcuccugcgggucuga

SEQ ID NO: 8986 - RNA, 21 nt, Artificial Sequence
  Guide Sequence
cuccugcgggucugaaggagc

SEQ ID NO: 8987 - RNA, 21 nt, Artificial Sequence
  Guide Sequence
cucucuggaucgcacuaacag

SEQ ID NO: 8988 - RNA, 21 nt, Artificial Sequence
  Guide Sequence
cucuggaucgcacuaacagag

SEQ ID NO: 8989 - RNA, 21 nt, Artificial Sequence
  Guide Sequence
cugaaaggagccacggaggcc

SEQ ID NO: 8990 - RNA, 21 nt, Artificial Sequence
  Guide Sequence
cugaaggagcucaccgacgcc

SEQ ID NO: 8991 - RNA, 21 nt, Artificial Sequence
  Guide Sequence
cugagggagaaagucaagcau

SEQ ID NO: 8992 - RNA, 21 nt, Artificial Sequence
  Guide Sequence
cugccaagagcacggacccca

SEQ ID NO: 8993 - RNA, 21 nt, Artificial Sequence
  Guide Sequence
cugcgggucugaaggagcuca

SEQ ID NO: 8994 - RNA, 21 nt, Artificial Sequence
  Guide Sequence
cugcgugugaggauccugcgc

SEQ ID NO: 8995 - RNA, 21 nt, Artificial Sequence
  Guide Sequence
cuggaaccggaacacaagcca

SEQ ID NO: 8996 - RNA, 21 nt, Artificial Sequence
  Guide Sequence
cuggaucgcacuaacagagcc

SEQ ID NO: 8997 - RNA, 21 nt, Artificial Sequence
  Guide Sequence
cuggcagagacgacugccaag

SEQ ID NO: 8998 - RNA, 21 nt, Artificial Sequence
  Guide Sequence
cuggggcucagaugggcaggc

SEQ ID NO: 8999 - RNA, 21 nt, Artificial Sequence
  Guide Sequence
cugugcccagaguacaaagag

SEQ ID NO: 9000 - RNA, 21 nt, Artificial Sequence
  Guide Sequence
cuucaacgccgggcuccggcu

SEQ ID NO: 9001 - RNA, 21 nt, Artificial Sequence
  Guide Sequence
cuucccacggccccuucaacg

SEQ ID NO: 9002 - RNA, 21 nt, Artificial Sequence
  Guide Sequence
cuuucgcuccagcgcauccua

SEQ ID NO: 9003 - RNA, 21 nt, Artificial Sequence
  Guide Sequence
gaaaagcacgauucagucauc

SEQ ID NO: 9004 - RNA, 21 nt, Artificial Sequence
  Guide Sequence
gaaaggagccacggaggcccc

SEQ ID NO: 9005 - RNA, 21 nt, Artificial Sequence
  Guide Sequence
gaaagucaagcaugugaacac

SEQ ID NO: 9006 - RNA, 21 nt, Artificial Sequence
  Guide Sequence
gaacacaagccaggccucacg

SEQ ID NO: 9007 - RNA, 21 nt, Artificial Sequence
  Guide Sequence
gaacacaggccuggcagagac

SEQ ID NO: 9008 - RNA, 21 nt, Artificial Sequence
  Guide Sequence
gaaccggaacacaagccaggc

SEQ ID NO: 9009 - RNA, 21 nt, Artificial Sequence
  Guide Sequence
gaaggagcucaccgacgccca

SEQ ID NO: 9010 - RNA, 21 nt, Artificial Sequence
  Guide Sequence
gacagccuccacccguuuuga

SEQ ID NO: 9011 - RNA, 21 nt, Artificial Sequence
  Guide Sequence
gaccccaccccaauccuuucg

SEQ ID NO: 9012 - RNA, 21 nt, Artificial Sequence
  Guide Sequence
gacgacugccaagagcacgga

SEQ ID NO: 9013 - RNA, 21 nt, Artificial Sequence
  Guide Sequence
gacgcccacggccucucugga

SEQ ID NO: 9014 - RNA, 21 nt, Artificial Sequence
  Guide Sequence
gacugccaagagcacggaccc

SEQ ID NO: 9015 - RNA, 21 nt, Artificial Sequence
  Guide Sequence
gagaaagucaagcaugugaac

SEQ ID NO: 9016 - RNA, 21 nt, Artificial Sequence
  Guide Sequence
gagacgacugccaagagcacg

SEQ ID NO: 9017 - RNA, 21 nt, Artificial Sequence
  Guide Sequence
gagaggcuggaaccggaacac

SEQ ID NO: 9018 - RNA, 21 nt, Artificial Sequence
  Guide Sequence
gagcacggaccccaccccaau

SEQ ID NO: 9019 - RNA, 21 nt, Artificial Sequence
  Guide Sequence
gagccacggaggccccaaaca

SEQ ID NO: 9020 - RNA, 21 nt, Artificial Sequence
  Guide Sequence
gagcccggccccugcguguga

SEQ ID NO: 9021 - RNA, 21 nt, Artificial Sequence
  Guide Sequence
gagcucaccgacgcccacggc

SEQ ID NO: 9022 - RNA, 21 nt, Artificial Sequence
  Guide Sequence
gaggauccugcgcgaccccac

SEQ ID NO: 9023 - RNA, 21 nt, Artificial Sequence
  Guide Sequence
gaggcuggaaccggaacacaa

SEQ ID NO: 9024 - RNA, 21 nt, Artificial Sequence
  Guide Sequence
gagggagaaagucaagcaugu

SEQ ID NO: 9025 - RNA, 21 nt, Artificial Sequence
  Guide Sequence
gaguacaaagagaggcuggaa

SEQ ID NO: 9026 - RNA, 21 nt, Artificial Sequence
  Guide Sequence
gaucgcacuaacagagcccgg

SEQ ID NO: 9027 - RNA, 21 nt, Artificial Sequence
  Guide Sequence
gaugggcaggccaaggcgaca

SEQ ID NO: 9028 - RNA, 21 nt, Artificial Sequence
  Guide Sequence
gauucagucaucuccacaaac

SEQ ID NO: 9029 - RNA, 21 nt, Artificial Sequence
  Guide Sequence
gcaaacacuggggcucagaug

SEQ ID NO: 9030 - RNA, 21 nt, Artificial Sequence
  Guide Sequence
gcacgauucagucaucuccac

SEQ ID NO: 9031 - RNA, 21 nt, Artificial Sequence
  Guide Sequence
gcacggaccccaccccaaucc

SEQ ID NO: 9032 - RNA, 21 nt, Artificial Sequence
  Guide Sequence
gcacuaacagagcccggcccc

SEQ ID NO: 9033 - RNA, 21 nt, Artificial Sequence
  Guide Sequence
gcagagacgacugccaagagc

SEQ ID NO: 9034 - RNA, 21 nt, Artificial Sequence
  Guide Sequence
gcaggccaaggcgacagccuc

SEQ ID NO: 9035 - RNA, 21 nt, Artificial Sequence
  Guide Sequence
gcauccuaaaccgugguaccc

SEQ ID NO: 9036 - RNA, 21 nt, Artificial Sequence
  Guide Sequence
gcaugugaacacaggccuggc

SEQ ID NO: 9037 - RNA, 21 nt, Artificial Sequence
  Guide Sequence
gccaagagcacggaccccacc

SEQ ID NO: 9038 - RNA, 21 nt, Artificial Sequence
  Guide Sequence
gccaaggcgacagccuccacc

SEQ ID NO: 9039 - RNA, 21 nt, Artificial Sequence
  Guide Sequence
gccacggaggccccaaacaag

SEQ ID NO: 9040 - RNA, 21 nt, Artificial Sequence
  Guide Sequence
gccaggccucacgcugaaagg

SEQ ID NO: 9041 - RNA, 21 nt, Artificial Sequence
  Guide Sequence
gcccacggccucucuggaucg

SEQ ID NO: 9042 - RNA, 21 nt, Artificial Sequence
  Guide Sequence
gcccagaguacaaagagaggc

SEQ ID NO: 9043 - RNA, 21 nt, Artificial Sequence
  Guide Sequence
gccccugcgugugaggauccu

SEQ ID NO: 9044 - RNA, 21 nt, Artificial Sequence
  Guide Sequence
gccccuucaacgccgggcucc

SEQ ID NO: 9045 - RNA, 21 nt, Artificial Sequence
  Guide Sequence
gcccuccccucaacacaacua

SEQ ID NO: 9046 - RNA, 21 nt, Artificial Sequence
  Guide Sequence
gccucacgcugaaaggagcca

SEQ ID NO: 9047 - RNA, 21 nt, Artificial Sequence
  Guide Sequence
gccuccacccguuuugaaccu

SEQ ID NO: 9048 - RNA, 21 nt, Artificial Sequence
  Guide Sequence
gccucucuggaucgcacuaac

SEQ ID NO: 9049 - RNA, 21 nt, Artificial Sequence
  Guide Sequence
gccuggcagagacgacugcca

SEQ ID NO: 9050 - RNA, 21 nt, Artificial Sequence
  Guide Sequence
gcgacagccuccacccguuuu

SEQ ID NO: 9051 - RNA, 21 nt, Artificial Sequence
  Guide Sequence
gcgcauccuaaaccgugguac

SEQ ID NO: 9052 - RNA, 21 nt, Artificial Sequence
  Guide Sequence
gcgggucugaaggagcucacc

SEQ ID NO: 9053 - RNA, 21 nt, Artificial Sequence
  Guide Sequence
gcgugugaggauccugcgcga

SEQ ID NO: 9054 - RNA, 21 nt, Artificial Sequence
  Guide Sequence
gcucaccgacgcccacggccu

SEQ ID NO: 9055 - RNA, 21 nt, Artificial Sequence
  Guide Sequence
gcucagaugggcaggccaagg

SEQ ID NO: 9056 - RNA, 21 nt, Artificial Sequence
  Guide Sequence
gcuccagcgcauccuaaaccg

SEQ ID NO: 9057 - RNA, 21 nt, Artificial Sequence
  Guide Sequence
gcuccggcuccugcgggucug

SEQ ID NO: 9058 - RNA, 21 nt, Artificial Sequence
  Guide Sequence
gcuccugcgggucugaaggag

SEQ ID NO: 9059 - RNA, 21 nt, Artificial Sequence
  Guide Sequence
gcugaaaggagccacggaggc

SEQ ID NO: 9060 - RNA, 21 nt, Artificial Sequence
  Guide Sequence
gcuggaaccggaacacaagcc

SEQ ID NO: 9061 - RNA, 21 nt, Artificial Sequence
  Guide Sequence
gcugugcccagaguacaaaga

SEQ ID NO: 9062 - RNA, 21 nt, Artificial Sequence
  Guide Sequence
ggaaaagcacgauucagucau

SEQ ID NO: 9063 - RNA, 21 nt, Artificial Sequence
  Guide Sequence
ggaacacaagccaggccucac

SEQ ID NO: 9064 - RNA, 21 nt, Artificial Sequence
  Guide Sequence
ggaaccggaacacaagccagg

SEQ ID NO: 9065 - RNA, 21 nt, Artificial Sequence
  Guide Sequence
ggaccccaccccaauccuuuc

SEQ ID NO: 9066 - RNA, 21 nt, Artificial Sequence
  Guide Sequence
ggagaaagucaagcaugugaa

SEQ ID NO: 9067 - RNA, 21 nt, Artificial Sequence
  Guide Sequence
ggagccacggaggccccaaac

SEQ ID NO: 9068 - RNA, 21 nt, Artificial Sequence
  Guide Sequence
ggagcucaccgacgcccacgg

SEQ ID NO: 9069 - RNA, 21 nt, Artificial Sequence
  Guide Sequence
ggaucgcacuaacagagcccg

SEQ ID NO: 9070 - RNA, 21 nt, Artificial Sequence
  Guide Sequence
ggcaaacacuggggcucagau

SEQ ID NO: 9071 - RNA, 21 nt, Artificial Sequence
  Guide Sequence
ggcagagacgacugccaagag

SEQ ID NO: 9072 - RNA, 21 nt, Artificial Sequence
  Guide Sequence
ggcaggccaaggcgacagccu

SEQ ID NO: 9073 - RNA, 21 nt, Artificial Sequence
  Guide Sequence
ggccaaggcgacagccuccac

SEQ ID NO: 9074 - RNA, 21 nt, Artificial Sequence
  Guide Sequence
ggccccugcgugugaggaucc

SEQ ID NO: 9075 - RNA, 21 nt, Artificial Sequence
  Guide Sequence
ggccccuucaacgccgggcuc

SEQ ID NO: 9076 - RNA, 21 nt, Artificial Sequence
  Guide Sequence
ggccucacgcugaaaggagcc

SEQ ID NO: 9077 - RNA, 21 nt, Artificial Sequence
  Guide Sequence
ggccucucuggaucgcacuaa

SEQ ID NO: 9078 - RNA, 21 nt, Artificial Sequence
  Guide Sequence
ggccuggcagagacgacugcc

SEQ ID NO: 9079 - RNA, 21 nt, Artificial Sequence
  Guide Sequence
ggcgacagccuccacccguuu

SEQ ID NO: 9080 - RNA, 21 nt, Artificial Sequence
  Guide Sequence
ggcucagaugggcaggccaag

SEQ ID NO: 9081 - RNA, 21 nt, Artificial Sequence
  Guide Sequence
ggcuccggcuccugcgggucu

SEQ ID NO: 9082 - RNA, 21 nt, Artificial Sequence
  Guide Sequence
ggcuccugcgggucugaagga

SEQ ID NO: 9083 - RNA, 21 nt, Artificial Sequence
  Guide Sequence
ggcuggaaccggaacacaagc

SEQ ID NO: 9084 - RNA, 21 nt, Artificial Sequence
  Guide Sequence
gggaaaagcacgauucaguca

SEQ ID NO: 9085 - RNA, 21 nt, Artificial Sequence
  Guide Sequence
gggagaaagucaagcauguga

SEQ ID NO: 9086 - RNA, 21 nt, Artificial Sequence
  Guide Sequence
gggcaggccaaggcgacagcc

SEQ ID NO: 9087 - RNA, 21 nt, Artificial Sequence
  Guide Sequence
gggcucagaugggcaggccaa

SEQ ID NO: 9088 - RNA, 21 nt, Artificial Sequence
  Guide Sequence
ggggcucagaugggcaggcca

SEQ ID NO: 9089 - RNA, 21 nt, Artificial Sequence
  Guide Sequence
gggucugaaggagcucaccga

SEQ ID NO: 9090 - RNA, 21 nt, Artificial Sequence
  Guide Sequence
gguaccccccguuacuuccca

SEQ ID NO: 9091 - RNA, 21 nt, Artificial Sequence
  Guide Sequence
ggucugaaggagcucaccgac

SEQ ID NO: 9092 - RNA, 21 nt, Artificial Sequence
  Guide Sequence
guacaaagagaggcuggaacc

SEQ ID NO: 9093 - RNA, 21 nt, Artificial Sequence
  Guide Sequence
guaccccccguuacuucccac

SEQ ID NO: 9094 - RNA, 21 nt, Artificial Sequence
  Guide Sequence
gucaagcaugugaacacaggc

SEQ ID NO: 9095 - RNA, 21 nt, Artificial Sequence
  Guide Sequence
gucaucuccacaaacuacccc

SEQ ID NO: 9096 - RNA, 21 nt, Artificial Sequence
  Guide Sequence
gucugaaggagcucaccgacg

SEQ ID NO: 9097 - RNA, 21 nt, Artificial Sequence
  Guide Sequence
gugaacacaggccuggcagag

SEQ ID NO: 9098 - RNA, 21 nt, Artificial Sequence
  Guide Sequence
gugaggauccugcgcgacccc

SEQ ID NO: 9099 - RNA, 21 nt, Artificial Sequence
  Guide Sequence
gugcccagaguacaaagagag

SEQ ID NO: 9100 - RNA, 21 nt, Artificial Sequence
  Guide Sequence
gugguaccccccguuacuucc

SEQ ID NO: 9101 - RNA, 21 nt, Artificial Sequence
  Guide Sequence
gugugaggauccugcgcgacc

SEQ ID NO: 9102 - RNA, 21 nt, Artificial Sequence
  Guide Sequence
guuacuucccacggccccuuc

SEQ ID NO: 9103 - RNA, 21 nt, Artificial Sequence
  Guide Sequence
guuuugaaccucaguccccaa

SEQ ID NO: 9104 - RNA, 21 nt, Artificial Sequence
  Guide Sequence
uaaaccgugguaccccccguu

SEQ ID NO: 9105 - RNA, 21 nt, Artificial Sequence
  Guide Sequence
uaacagagcccggccccugcg

SEQ ID NO: 9106 - RNA, 21 nt, Artificial Sequence
  Guide Sequence
uacaaagagaggcuggaaccg

SEQ ID NO: 9107 - RNA, 21 nt, Artificial Sequence
  Guide Sequence
uaccccauaucccaaaugccc

SEQ ID NO: 9108 - RNA, 21 nt, Artificial Sequence
  Guide Sequence
uaccccccguuacuucccacg

SEQ ID NO: 9109 - RNA, 21 nt, Artificial Sequence
  Guide Sequence
uacuucccacggccccuucaa

SEQ ID NO: 9110 - RNA, 21 nt, Artificial Sequence
  Guide Sequence
uaucccaaaugcccuccccuc

SEQ ID NO: 9111 - RNA, 21 nt, Artificial Sequence
  Guide Sequence
uaugcugugcccagaguacaa

SEQ ID NO: 9112 - RNA, 21 nt, Artificial Sequence
  Guide Sequence
ucaacacaacuaugcugugcc

SEQ ID NO: 9113 - RNA, 21 nt, Artificial Sequence
  Guide Sequence
ucaacgccgggcuccggcucc

SEQ ID NO: 9114 - RNA, 21 nt, Artificial Sequence
  Guide Sequence
ucaagcaugugaacacaggcc

SEQ ID NO: 9115 - RNA, 21 nt, Artificial Sequence
  Guide Sequence
ucaccgacgcccacggccucu

SEQ ID NO: 9116 - RNA, 21 nt, Artificial Sequence
  Guide Sequence
ucacgcugaaaggagccacgg

SEQ ID NO: 9117 - RNA, 21 nt, Artificial Sequence
  Guide Sequence
ucagaugggcaggccaaggcg

SEQ ID NO: 9118 - RNA, 21 nt, Artificial Sequence
  Guide Sequence
ucagucaucuccacaaacuac

SEQ ID NO: 9119 - RNA, 21 nt, Artificial Sequence
  Guide Sequence
ucaucuccacaaacuacccca

SEQ ID NO: 9120 - RNA, 21 nt, Artificial Sequence
  Guide Sequence
uccacaaacuaccccauaucc

SEQ ID NO: 9121 - RNA, 21 nt, Artificial Sequence
  Guide Sequence
uccacccguuuugaaccucag

SEQ ID NO: 9122 - RNA, 21 nt, Artificial Sequence
  Guide Sequence
uccagcgcauccuaaaccgug

SEQ ID NO: 9123 - RNA, 21 nt, Artificial Sequence
  Guide Sequence
ucccaaaugcccuccccucaa

SEQ ID NO: 9124 - RNA, 21 nt, Artificial Sequence
  Guide Sequence
ucccacggccccuucaacgcc

SEQ ID NO: 9125 - RNA, 21 nt, Artificial Sequence
  Guide Sequence
uccccucaacacaacuaugcu

SEQ ID NO: 9126 - RNA, 21 nt, Artificial Sequence
  Guide Sequence
uccggcuccugcgggucugaa

SEQ ID NO: 9127 - RNA, 21 nt, Artificial Sequence
  Guide Sequence
uccuaaaccgugguacccccc

SEQ ID NO: 9128 - RNA, 21 nt, Artificial Sequence
  Guide Sequence
uccugcgggucugaaggagcu

SEQ ID NO: 9129 - RNA, 21 nt, Artificial Sequence
  Guide Sequence
uccuuucgcuccagcgcaucc

SEQ ID NO: 9130 - RNA, 21 nt, Artificial Sequence
  Guide Sequence
ucgcacuaacagagcccggcc

SEQ ID NO: 9131 - RNA, 21 nt, Artificial Sequence
  Guide Sequence
ucgcuccagcgcauccuaaac

SEQ ID NO: 9132 - RNA, 21 nt, Artificial Sequence
  Guide Sequence
ucuccacaaacuaccccauau

SEQ ID NO: 9133 - RNA, 21 nt, Artificial Sequence
  Guide Sequence
ucucuggaucgcacuaacaga

SEQ ID NO: 9134 - RNA, 21 nt, Artificial Sequence
  Guide Sequence
ucugaaggagcucaccgacgc

SEQ ID NO: 9135 - RNA, 21 nt, Artificial Sequence
  Guide Sequence
ucuggaucgcacuaacagagc

SEQ ID NO: 9136 - RNA, 21 nt, Artificial Sequence
  Guide Sequence
ugaaaggagccacggaggccc

SEQ ID NO: 9137 - RNA, 21 nt, Artificial Sequence
  Guide Sequence
ugaacacaggccuggcagaga

SEQ ID NO: 9138 - RNA, 21 nt, Artificial Sequence
  Guide Sequence
ugaaggagcucaccgacgccc

SEQ ID NO: 9139 - RNA, 21 nt, Artificial Sequence
  Guide Sequence
ugaggauccugcgcgacccca

SEQ ID NO: 9140 - RNA, 21 nt, Artificial Sequence
  Guide Sequence
ugagggagaaagucaagcaug

SEQ ID NO: 9141 - RNA, 21 nt, Artificial Sequence
  Guide Sequence
ugccaagagcacggaccccac

SEQ ID NO: 9142 - RNA, 21 nt, Artificial Sequence
  Guide Sequence
ugcccagaguacaaagagagg

SEQ ID NO: 9143 - RNA, 21 nt, Artificial Sequence
  Guide Sequence
ugcccuccccucaacacaacu

SEQ ID NO: 9144 - RNA, 21 nt, Artificial Sequence
  Guide Sequence
ugcgggucugaaggagcucac

SEQ ID NO: 9145 - RNA, 21 nt, Artificial Sequence
  Guide Sequence
ugcgugugaggauccugcgcg

SEQ ID NO: 9146 - RNA, 21 nt, Artificial Sequence
  Guide Sequence
ugcugugcccagaguacaaag

SEQ ID NO: 9147 - RNA, 21 nt, Artificial Sequence
  Guide Sequence
uggaaccggaacacaagccag

SEQ ID NO: 9148 - RNA, 21 nt, Artificial Sequence
  Guide Sequence
uggaucgcacuaacagagccc

SEQ ID NO: 9149 - RNA, 21 nt, Artificial Sequence
  Guide Sequence
uggcagagacgacugccaaga

SEQ ID NO: 9150 - RNA, 21 nt, Artificial Sequence
  Guide Sequence
ugggcaggccaaggcgacagc

SEQ ID NO: 9151 - RNA, 21 nt, Artificial Sequence
  Guide Sequence
uggggcucagaugggcaggcc

SEQ ID NO: 9152 - RNA, 21 nt, Artificial Sequence
  Guide Sequence
ugguaccccccguuacuuccc

SEQ ID NO: 9153 - RNA, 21 nt, Artificial Sequence
  Guide Sequence
ugugaacacaggccuggcaga

SEQ ID NO: 9154 - RNA, 21 nt, Artificial Sequence
  Guide Sequence
ugugaggauccugcgcgaccc

SEQ ID NO: 9155 - RNA, 21 nt, Artificial Sequence
  Guide Sequence
ugugcccagaguacaaagaga

SEQ ID NO: 9156 - RNA, 21 nt, Artificial Sequence
  Guide Sequence
uuacuucccacggccccuuca

SEQ ID NO: 9157 - RNA, 21 nt, Artificial Sequence
  Guide Sequence
uucaacgccgggcuccggcuc

SEQ ID NO: 9158 - RNA, 21 nt, Artificial Sequence
  Guide Sequence
uucagucaucuccacaaacua

SEQ ID NO: 9159 - RNA, 21 nt, Artificial Sequence
  Guide Sequence
uucccacggccccuucaacgc

SEQ ID NO: 9160 - RNA, 21 nt, Artificial Sequence
  Guide Sequence
uucgcuccagcgcauccuaaa

SEQ ID NO: 9161 - RNA, 21 nt, Artificial Sequence
  Guide Sequence
uuucgcuccagcgcauccuaa

SEQ ID NO: 9162 - RNA, 21 nt, Artificial Sequence
  Guide Sequence
uuugaaccucaguccccaaac

SEQ ID NO: 9163 - RNA, 21 nt, Artificial Sequence
  Guide Sequence
uuuugaaccucaguccccaaa

SEQ ID NO: 9164 - RNA, 22 nt, Artificial Sequence
  Guide Sequence
aaaagcacgauucagucaucuc

SEQ ID NO: 9165 - RNA, 22 nt, Artificial Sequence
  Guide Sequence
aaacacuggggcucagaugggc

SEQ ID NO: 9166 - RNA, 22 nt, Artificial Sequence
  Guide Sequence
aaaccgugguaccccccguuac

SEQ ID NO: 9167 - RNA, 22 nt, Artificial Sequence
  Guide Sequence
aaacuaccccauaucccaaaug

SEQ ID NO: 9168 - RNA, 22 nt, Artificial Sequence
  Guide Sequence
aaagagaggcuggaaccggaac

SEQ ID NO: 9169 - RNA, 22 nt, Artificial Sequence
  Guide Sequence
aaagcacgauucagucaucucc

SEQ ID NO: 9170 - RNA, 22 nt, Artificial Sequence
  Guide Sequence
aaaggagccacggaggccccaa

SEQ ID NO: 9171 - RNA, 22 nt, Artificial Sequence
  Guide Sequence
aaagucaagcaugugaacacag

SEQ ID NO: 9172 - RNA, 22 nt, Artificial Sequence
  Guide Sequence
aaaugcccuccccucaacacaa

SEQ ID NO: 9173 - RNA, 22 nt, Artificial Sequence
  Guide Sequence
aacacaacuaugcugugcccag

SEQ ID NO: 9174 - RNA, 22 nt, Artificial Sequence
  Guide Sequence
aacacaagccaggccucacgcu

SEQ ID NO: 9175 - RNA, 22 nt, Artificial Sequence
  Guide Sequence
aacacaggccuggcagagacga

SEQ ID NO: 9176 - RNA, 22 nt, Artificial Sequence
  Guide Sequence
aacacuggggcucagaugggca

SEQ ID NO: 9177 - RNA, 22 nt, Artificial Sequence
  Guide Sequence
aacagagcccggccccugcgug

SEQ ID NO: 9178 - RNA, 22 nt, Artificial Sequence
  Guide Sequence
aaccggaacacaagccaggccu

SEQ ID NO: 9179 - RNA, 22 nt, Artificial Sequence
  Guide Sequence
aaccgugguaccccccguuacu

SEQ ID NO: 9180 - RNA, 22 nt, Artificial Sequence
  Guide Sequence
aacgccgggcuccggcuccugc

SEQ ID NO: 9181 - RNA, 22 nt, Artificial Sequence
  Guide Sequence
aacuaccccauaucccaaaugc

SEQ ID NO: 9182 - RNA, 22 nt, Artificial Sequence
  Guide Sequence
aacuaugcugugcccagaguac

SEQ ID NO: 9183 - RNA, 22 nt, Artificial Sequence
  Guide Sequence
aagagaggcuggaaccggaaca

SEQ ID NO: 9184 - RNA, 22 nt, Artificial Sequence
  Guide Sequence
aagagcacggaccccaccccaa

SEQ ID NO: 9185 - RNA, 22 nt, Artificial Sequence
  Guide Sequence
aagcacgauucagucaucucca

SEQ ID NO: 9186 - RNA, 22 nt, Artificial Sequence
  Guide Sequence
aagcaugugaacacaggccugg

SEQ ID NO: 9187 - RNA, 22 nt, Artificial Sequence
  Guide Sequence
aagccaggccucacgcugaaag

SEQ ID NO: 9188 - RNA, 22 nt, Artificial Sequence
  Guide Sequence
aaggagccacggaggccccaaa

SEQ ID NO: 9189 - RNA, 22 nt, Artificial Sequence
  Guide Sequence
aaggagcucaccgacgcccacg

SEQ ID NO: 9190 - RNA, 22 nt, Artificial Sequence
  Guide Sequence
aaggcgacagccuccacccguu

SEQ ID NO: 9191 - RNA, 22 nt, Artificial Sequence
  Guide Sequence
aagucaagcaugugaacacagg

SEQ ID NO: 9192 - RNA, 22 nt, Artificial Sequence
  Guide Sequence
aauccuuucgcuccagcgcauc

SEQ ID NO: 9193 - RNA, 22 nt, Artificial Sequence
  Guide Sequence
aaugcccuccccucaacacaac

SEQ ID NO: 9194 - RNA, 22 nt, Artificial Sequence
  Guide Sequence
acaaacuaccccauaucccaaa

SEQ ID NO: 9195 - RNA, 22 nt, Artificial Sequence
  Guide Sequence
acaaagagaggcuggaaccgga

SEQ ID NO: 9196 - RNA, 22 nt, Artificial Sequence
  Guide Sequence
acaacuaugcugugcccagagu

SEQ ID NO: 9197 - RNA, 22 nt, Artificial Sequence
  Guide Sequence
acaagccaggccucacgcugaa

SEQ ID NO: 9198 - RNA, 22 nt, Artificial Sequence
  Guide Sequence
acacaacuaugcugugcccaga

SEQ ID NO: 9199 - RNA, 22 nt, Artificial Sequence
  Guide Sequence
acacaagccaggccucacgcug

SEQ ID NO: 9200 - RNA, 22 nt, Artificial Sequence
  Guide Sequence
acacaggccuggcagagacgac

SEQ ID NO: 9201 - RNA, 22 nt, Artificial Sequence
  Guide Sequence
acacuggggcucagaugggcag

SEQ ID NO: 9202 - RNA, 22 nt, Artificial Sequence
  Guide Sequence
acagagcccggccccugcgugu

SEQ ID NO: 9203 - RNA, 22 nt, Artificial Sequence
  Guide Sequence
acagccuccacccguuuugaac

SEQ ID NO: 9204 - RNA, 22 nt, Artificial Sequence
  Guide Sequence
acaggccuggcagagacgacug

SEQ ID NO: 9205 - RNA, 22 nt, Artificial Sequence
  Guide Sequence
accccaauccuuucgcuccagc

SEQ ID NO: 9206 - RNA, 22 nt, Artificial Sequence
  Guide Sequence
accccaccccaauccuuucgcu

SEQ ID NO: 9207 - RNA, 22 nt, Artificial Sequence
  Guide Sequence
accccauaucccaaaugcccuc

SEQ ID NO: 9208 - RNA, 22 nt, Artificial Sequence
  Guide Sequence
accccccguuacuucccacggc

SEQ ID NO: 9209 - RNA, 22 nt, Artificial Sequence
  Guide Sequence
accgacgcccacggccucucug

SEQ ID NO: 9210 - RNA, 22 nt, Artificial Sequence
  Guide Sequence
accggaacacaagccaggccuc

SEQ ID NO: 9211 - RNA, 22 nt, Artificial Sequence
  Guide Sequence
accggcaaacacuggggcucag

SEQ ID NO: 9212 - RNA, 22 nt, Artificial Sequence
  Guide Sequence
accgugguaccccccguuacuu

SEQ ID NO: 9213 - RNA, 22 nt, Artificial Sequence
  Guide Sequence
acgacugccaagagcacggacc

SEQ ID NO: 9214 - RNA, 22 nt, Artificial Sequence
  Guide Sequence
acgauucagucaucuccacaaa

SEQ ID NO: 9215 - RNA, 22 nt, Artificial Sequence
  Guide Sequence
acgcccacggccucucuggauc

SEQ ID NO: 9216 - RNA, 22 nt, Artificial Sequence
  Guide Sequence
acgcugaaaggagccacggagg

SEQ ID NO: 9217 - RNA, 22 nt, Artificial Sequence
  Guide Sequence
acggaccccaccccaauccuuu

SEQ ID NO: 9218 - RNA, 22 nt, Artificial Sequence
  Guide Sequence
acggccccuucaacgccgggcu

SEQ ID NO: 9219 - RNA, 22 nt, Artificial Sequence
  Guide Sequence
acggccucucuggaucgcacua

SEQ ID NO: 9220 - RNA, 22 nt, Artificial Sequence
  Guide Sequence
acuaacagagcccggccccugc

SEQ ID NO: 9221 - RNA, 22 nt, Artificial Sequence
  Guide Sequence
acuaccccauaucccaaaugcc

SEQ ID NO: 9222 - RNA, 22 nt, Artificial Sequence
  Guide Sequence
acuaugcugugcccagaguaca

SEQ ID NO: 9223 - RNA, 22 nt, Artificial Sequence
  Guide Sequence
acugccaagagcacggacccca

SEQ ID NO: 9224 - RNA, 22 nt, Artificial Sequence
  Guide Sequence
acuggggcucagaugggcaggc

SEQ ID NO: 9225 - RNA, 22 nt, Artificial Sequence
  Guide Sequence
acuucccacggccccuucaacg

SEQ ID NO: 9226 - RNA, 22 nt, Artificial Sequence
  Guide Sequence
agaaagucaagcaugugaacac

SEQ ID NO: 9227 - RNA, 22 nt, Artificial Sequence
  Guide Sequence
agacgacugccaagagcacgga

SEQ ID NO: 9228 - RNA, 22 nt, Artificial Sequence
  Guide Sequence
agagacgacugccaagagcacg

SEQ ID NO: 9229 - RNA, 22 nt, Artificial Sequence
  Guide Sequence
agagaggcuggaaccggaacac

SEQ ID NO: 9230 - RNA, 22 nt, Artificial Sequence
  Guide Sequence
agagcacggaccccaccccaau

SEQ ID NO: 9231 - RNA, 22 nt, Artificial Sequence
  Guide Sequence
agagcccggccccugcguguga

SEQ ID NO: 9232 - RNA, 22 nt, Artificial Sequence
  Guide Sequence
agaggcuggaaccggaacacaa

SEQ ID NO: 9233 - RNA, 22 nt, Artificial Sequence
  Guide Sequence
agaguacaaagagaggcuggaa

SEQ ID NO: 9234 - RNA, 22 nt, Artificial Sequence
  Guide Sequence
agaugggcaggccaaggcgaca

SEQ ID NO: 9235 - RNA, 22 nt, Artificial Sequence
  Guide Sequence
agcacgauucagucaucuccac

SEQ ID NO: 9236 - RNA, 22 nt, Artificial Sequence
  Guide Sequence
agcacggaccccaccccaaucc

SEQ ID NO: 9237 - RNA, 22 nt, Artificial Sequence
  Guide Sequence
agcaugugaacacaggccuggc

SEQ ID NO: 9238 - RNA, 22 nt, Artificial Sequence
  Guide Sequence
agccacggaggccccaaacaag

SEQ ID NO: 9239 - RNA, 22 nt, Artificial Sequence
  Guide Sequence
agccaggccucacgcugaaagg

SEQ ID NO: 9240 - RNA, 22 nt, Artificial Sequence
  Guide Sequence
agcccggccccugcgugugagg

SEQ ID NO: 9241 - RNA, 22 nt, Artificial Sequence
  Guide Sequence
agccuccacccguuuugaaccu

SEQ ID NO: 9242 - RNA, 22 nt, Artificial Sequence
  Guide Sequence
agcgcauccuaaaccgugguac

SEQ ID NO: 9243 - RNA, 22 nt, Artificial Sequence
  Guide Sequence
agcucaccgacgcccacggccu

SEQ ID NO: 9244 - RNA, 22 nt, Artificial Sequence
  Guide Sequence
aggagccacggaggccccaaac

SEQ ID NO: 9245 - RNA, 22 nt, Artificial Sequence
  Guide Sequence
aggagcucaccgacgcccacgg

SEQ ID NO: 9246 - RNA, 22 nt, Artificial Sequence
  Guide Sequence
aggccaaggcgacagccuccac

SEQ ID NO: 9247 - RNA, 22 nt, Artificial Sequence
  Guide Sequence
aggccucacgcugaaaggagcc

SEQ ID NO: 9248 - RNA, 22 nt, Artificial Sequence
  Guide Sequence
aggccuggcagagacgacugcc

SEQ ID NO: 9249 - RNA, 22 nt, Artificial Sequence
  Guide Sequence
aggcgacagccuccacccguuu

SEQ ID NO: 9250 - RNA, 22 nt, Artificial Sequence
  Guide Sequence
aggcuggaaccggaacacaagc

SEQ ID NO: 9251 - RNA, 22 nt, Artificial Sequence
  Guide Sequence
agggagaaagucaagcauguga

SEQ ID NO: 9252 - RNA, 22 nt, Artificial Sequence
  Guide Sequence
aguacaaagagaggcuggaacc

SEQ ID NO: 9253 - RNA, 22 nt, Artificial Sequence
  Guide Sequence
agucaagcaugugaacacaggc

SEQ ID NO: 9254 - RNA, 22 nt, Artificial Sequence
  Guide Sequence
agucaucuccacaaacuacccc

SEQ ID NO: 9255 - RNA, 22 nt, Artificial Sequence
  Guide Sequence
auaucccaaaugcccuccccuc

SEQ ID NO: 9256 - RNA, 22 nt, Artificial Sequence
  Guide Sequence
aucccaaaugcccuccccucaa

SEQ ID NO: 9257 - RNA, 22 nt, Artificial Sequence
  Guide Sequence
auccuaaaccgugguacccccc

SEQ ID NO: 9258 - RNA, 22 nt, Artificial Sequence
  Guide Sequence
auccuuucgcuccagcgcaucc

SEQ ID NO: 9259 - RNA, 22 nt, Artificial Sequence
  Guide Sequence
aucgcacuaacagagcccggcc

SEQ ID NO: 9260 - RNA, 22 nt, Artificial Sequence
  Guide Sequence
aucuccacaaacuaccccauau

SEQ ID NO: 9261 - RNA, 22 nt, Artificial Sequence
  Guide Sequence
augcccuccccucaacacaacu

SEQ ID NO: 9262 - RNA, 22 nt, Artificial Sequence
  Guide Sequence
augcugugcccagaguacaaag

SEQ ID NO: 9263 - RNA, 22 nt, Artificial Sequence
  Guide Sequence
augggcaggccaaggcgacagc

SEQ ID NO: 9264 - RNA, 22 nt, Artificial Sequence
  Guide Sequence
augugaacacaggccuggcaga

SEQ ID NO: 9265 - RNA, 22 nt, Artificial Sequence
  Guide Sequence
auucagucaucuccacaaacua

SEQ ID NO: 9266 - RNA, 22 nt, Artificial Sequence
  Guide Sequence
caaacacuggggcucagauggg

SEQ ID NO: 9267 - RNA, 22 nt, Artificial Sequence
  Guide Sequence
caaacuaccccauaucccaaau

SEQ ID NO: 9268 - RNA, 22 nt, Artificial Sequence
  Guide Sequence
caaagagaggcuggaaccggaa

SEQ ID NO: 9269 - RNA, 22 nt, Artificial Sequence
  Guide Sequence
caaaugcccuccccucaacaca

SEQ ID NO: 9270 - RNA, 22 nt, Artificial Sequence
  Guide Sequence
caacacaacuaugcugugccca

SEQ ID NO: 9271 - RNA, 22 nt, Artificial Sequence
  Guide Sequence
caacgccgggcuccggcuccug

SEQ ID NO: 9272 - RNA, 22 nt, Artificial Sequence
  Guide Sequence
caacuaugcugugcccagagua

SEQ ID NO: 9273 - RNA, 22 nt, Artificial Sequence
  Guide Sequence
caagagcacggaccccacccca

SEQ ID NO: 9274 - RNA, 22 nt, Artificial Sequence
  Guide Sequence
caagcaugugaacacaggccug

SEQ ID NO: 9275 - RNA, 22 nt, Artificial Sequence
  Guide Sequence
caagccaggccucacgcugaaa

SEQ ID NO: 9276 - RNA, 22 nt, Artificial Sequence
  Guide Sequence
caaggcgacagccuccacccgu

SEQ ID NO: 9277 - RNA, 22 nt, Artificial Sequence
  Guide Sequence
caauccuuucgcuccagcgcau

SEQ ID NO: 9278 - RNA, 22 nt, Artificial Sequence
  Guide Sequence
cacaaacuaccccauaucccaa

SEQ ID NO: 9279 - RNA, 22 nt, Artificial Sequence
  Guide Sequence
cacaacuaugcugugcccagag

SEQ ID NO: 9280 - RNA, 22 nt, Artificial Sequence
  Guide Sequence
cacaagccaggccucacgcuga

SEQ ID NO: 9281 - RNA, 22 nt, Artificial Sequence
  Guide Sequence
cacaggccuggcagagacgacu

SEQ ID NO: 9282 - RNA, 22 nt, Artificial Sequence
  Guide Sequence
caccccaauccuuucgcuccag

SEQ ID NO: 9283 - RNA, 22 nt, Artificial Sequence
  Guide Sequence
caccgacgcccacggccucucu

SEQ ID NO: 9284 - RNA, 22 nt, Artificial Sequence
  Guide Sequence
cacgauucagucaucuccacaa

SEQ ID NO: 9285 - RNA, 22 nt, Artificial Sequence
  Guide Sequence
cacgcugaaaggagccacggag

SEQ ID NO: 9286 - RNA, 22 nt, Artificial Sequence
  Guide Sequence
cacggaccccaccccaauccuu

SEQ ID NO: 9287 - RNA, 22 nt, Artificial Sequence
  Guide Sequence
cacggccccuucaacgccgggc

SEQ ID NO: 9288 - RNA, 22 nt, Artificial Sequence
  Guide Sequence
cacggccucucuggaucgcacu

SEQ ID NO: 9289 - RNA, 22 nt, Artificial Sequence
  Guide Sequence
cacuaacagagcccggccccug

SEQ ID NO: 9290 - RNA, 22 nt, Artificial Sequence
  Guide Sequence
cacuggggcucagaugggcagg

SEQ ID NO: 9291 - RNA, 22 nt, Artificial Sequence
  Guide Sequence
cagagacgacugccaagagcac

SEQ ID NO: 9292 - RNA, 22 nt, Artificial Sequence
  Guide Sequence
cagagcccggccccugcgugug

SEQ ID NO: 9293 - RNA, 22 nt, Artificial Sequence
  Guide Sequence
cagaguacaaagagaggcugga

SEQ ID NO: 9294 - RNA, 22 nt, Artificial Sequence
  Guide Sequence
cagaugggcaggccaaggcgac

SEQ ID NO: 9295 - RNA, 22 nt, Artificial Sequence
  Guide Sequence
cagccuccacccguuuugaacc

SEQ ID NO: 9296 - RNA, 22 nt, Artificial Sequence
  Guide Sequence
cagcgcauccuaaaccguggua

SEQ ID NO: 9297 - RNA, 22 nt, Artificial Sequence
  Guide Sequence
caggccaaggcgacagccucca

SEQ ID NO: 9298 - RNA, 22 nt, Artificial Sequence
  Guide Sequence
caggccucacgcugaaaggagc

SEQ ID NO: 9299 - RNA, 22 nt, Artificial Sequence
  Guide Sequence
caggccuggcagagacgacugc

SEQ ID NO: 9300 - RNA, 22 nt, Artificial Sequence
  Guide Sequence
cagucaucuccacaaacuaccc

SEQ ID NO: 9301 - RNA, 22 nt, Artificial Sequence
  Guide Sequence
cauaucccaaaugcccuccccu

SEQ ID NO: 9302 - RNA, 22 nt, Artificial Sequence
  Guide Sequence
cauccuaaaccgugguaccccc

SEQ ID NO: 9303 - RNA, 22 nt, Artificial Sequence
  Guide Sequence
caucuccacaaacuaccccaua

SEQ ID NO: 9304 - RNA, 22 nt, Artificial Sequence
  Guide Sequence
caugugaacacaggccuggcag

SEQ ID NO: 9305 - RNA, 22 nt, Artificial Sequence
  Guide Sequence
ccaaaugcccuccccucaacac

SEQ ID NO: 9306 - RNA, 22 nt, Artificial Sequence
  Guide Sequence
ccaagagcacggaccccacccc

SEQ ID NO: 9307 - RNA, 22 nt, Artificial Sequence
  Guide Sequence
ccaaggcgacagccuccacccg

SEQ ID NO: 9308 - RNA, 22 nt, Artificial Sequence
  Guide Sequence
ccaauccuuucgcuccagcgca

SEQ ID NO: 9309 - RNA, 22 nt, Artificial Sequence
  Guide Sequence
ccacaaacuaccccauauccca

SEQ ID NO: 9310 - RNA, 22 nt, Artificial Sequence
  Guide Sequence
ccaccccaauccuuucgcucca

SEQ ID NO: 9311 - RNA, 22 nt, Artificial Sequence
  Guide Sequence
ccacggccccuucaacgccggg

SEQ ID NO: 9312 - RNA, 22 nt, Artificial Sequence
  Guide Sequence
ccacggccucucuggaucgcac

SEQ ID NO: 9313 - RNA, 22 nt, Artificial Sequence
  Guide Sequence
ccagaguacaaagagaggcugg

SEQ ID NO: 9314 - RNA, 22 nt, Artificial Sequence
  Guide Sequence
ccagcgcauccuaaaccguggu

SEQ ID NO: 9315 - RNA, 22 nt, Artificial Sequence
  Guide Sequence
ccaggccucacgcugaaaggag

SEQ ID NO: 9316 - RNA, 22 nt, Artificial Sequence
  Guide Sequence
ccauaucccaaaugcccucccc

SEQ ID NO: 9317 - RNA, 22 nt, Artificial Sequence
  Guide Sequence
cccaaaugcccuccccucaaca

SEQ ID NO: 9318 - RNA, 22 nt, Artificial Sequence
  Guide Sequence
cccaauccuuucgcuccagcgc

SEQ ID NO: 9319 - RNA, 22 nt, Artificial Sequence
  Guide Sequence
cccaccccaauccuuucgcucc

SEQ ID NO: 9320 - RNA, 22 nt, Artificial Sequence
  Guide Sequence
cccacggccccuucaacgccgg

SEQ ID NO: 9321 - RNA, 22 nt, Artificial Sequence
  Guide Sequence
cccacggccucucuggaucgca

SEQ ID NO: 9322 - RNA, 22 nt, Artificial Sequence
  Guide Sequence
cccagaguacaaagagaggcug

SEQ ID NO: 9323 - RNA, 22 nt, Artificial Sequence
  Guide Sequence
cccauaucccaaaugcccuccc

SEQ ID NO: 9324 - RNA, 22 nt, Artificial Sequence
  Guide Sequence
ccccaauccuuucgcuccagcg

SEQ ID NO: 9325 - RNA, 22 nt, Artificial Sequence
  Guide Sequence
ccccaccccaauccuuucgcuc

SEQ ID NO: 9326 - RNA, 22 nt, Artificial Sequence
  Guide Sequence
ccccauaucccaaaugcccucc

SEQ ID NO: 9327 - RNA, 22 nt, Artificial Sequence
  Guide Sequence
ccccccguuacuucccacggcc

SEQ ID NO: 9328 - RNA, 22 nt, Artificial Sequence
  Guide Sequence
cccccguuacuucccacggccc

SEQ ID NO: 9329 - RNA, 22 nt, Artificial Sequence
  Guide Sequence
ccccguuacuucccacggcccc

SEQ ID NO: 9330 - RNA, 22 nt, Artificial Sequence
  Guide Sequence
ccccucaacacaacuaugcugu

SEQ ID NO: 9331 - RNA, 22 nt, Artificial Sequence
  Guide Sequence
ccccugcgugugaggauccugc

SEQ ID NO: 9332 - RNA, 22 nt, Artificial Sequence
  Guide Sequence
ccccuucaacgccgggcuccgg

SEQ ID NO: 9333 - RNA, 22 nt, Artificial Sequence
  Guide Sequence
cccggccccugcgugugaggau

SEQ ID NO: 9334 - RNA, 22 nt, Artificial Sequence
  Guide Sequence
cccguuacuucccacggccccu

SEQ ID NO: 9335 - RNA, 22 nt, Artificial Sequence
  Guide Sequence
cccguuuugaaccucagucccc

SEQ ID NO: 9336 - RNA, 22 nt, Artificial Sequence
  Guide Sequence
cccucaacacaacuaugcugug

SEQ ID NO: 9337 - RNA, 22 nt, Artificial Sequence
  Guide Sequence
cccuccccucaacacaacuaug

SEQ ID NO: 9338 - RNA, 22 nt, Artificial Sequence
  Guide Sequence
cccugcgugugaggauccugcg

SEQ ID NO: 9339 - RNA, 22 nt, Artificial Sequence
  Guide Sequence
cccuucaacgccgggcuccggc

SEQ ID NO: 9340 - RNA, 22 nt, Artificial Sequence
  Guide Sequence
ccgacgcccacggccucucugg

SEQ ID NO: 9341 - RNA, 22 nt, Artificial Sequence
  Guide Sequence
ccggaacacaagccaggccuca

SEQ ID NO: 9342 - RNA, 22 nt, Artificial Sequence
  Guide Sequence
ccggcaaacacuggggcucaga

SEQ ID NO: 9343 - RNA, 22 nt, Artificial Sequence
  Guide Sequence
ccggccccugcgugugaggauc

SEQ ID NO: 9344 - RNA, 22 nt, Artificial Sequence
  Guide Sequence
ccggcuccugcgggucugaagg

SEQ ID NO: 9345 - RNA, 22 nt, Artificial Sequence
  Guide Sequence
ccgugguaccccccguuacuuc

SEQ ID NO: 9346 - RNA, 22 nt, Artificial Sequence
  Guide Sequence
ccguuacuucccacggccccuu

SEQ ID NO: 9347 - RNA, 22 nt, Artificial Sequence
  Guide Sequence
ccguuuugaaccucagucccca

SEQ ID NO: 9348 - RNA, 22 nt, Artificial Sequence
  Guide Sequence
ccuaaaccgugguaccccccgu

SEQ ID NO: 9349 - RNA, 22 nt, Artificial Sequence
  Guide Sequence
ccucaacacaacuaugcugugc

SEQ ID NO: 9350 - RNA, 22 nt, Artificial Sequence
  Guide Sequence
ccucacgcugaaaggagccacg

SEQ ID NO: 9351 - RNA, 22 nt, Artificial Sequence
  Guide Sequence
ccuccacccguuuugaaccuca

SEQ ID NO: 9352 - RNA, 22 nt, Artificial Sequence
  Guide Sequence
ccuccccucaacacaacuaugc

SEQ ID NO: 9353 - RNA, 22 nt, Artificial Sequence
  Guide Sequence
ccucucuggaucgcacuaacag

SEQ ID NO: 9354 - RNA, 22 nt, Artificial Sequence
  Guide Sequence
ccugcgggucugaaggagcuca

SEQ ID NO: 9355 - RNA, 22 nt, Artificial Sequence
  Guide Sequence
ccugcgugugaggauccugcgc

SEQ ID NO: 9356 - RNA, 22 nt, Artificial Sequence
  Guide Sequence
ccuggcagagacgacugccaag

SEQ ID NO: 9357 - RNA, 22 nt, Artificial Sequence
  Guide Sequence
ccuucaacgccgggcuccggcu

SEQ ID NO: 9358 - RNA, 22 nt, Artificial Sequence
  Guide Sequence
ccuuucgcuccagcgcauccua

SEQ ID NO: 9359 - RNA, 22 nt, Artificial Sequence
  Guide Sequence
cgacagccuccacccguuuuga

SEQ ID NO: 9360 - RNA, 22 nt, Artificial Sequence
  Guide Sequence
cgacgcccacggccucucugga

SEQ ID NO: 9361 - RNA, 22 nt, Artificial Sequence
  Guide Sequence
cgacugccaagagcacggaccc

SEQ ID NO: 9362 - RNA, 22 nt, Artificial Sequence
  Guide Sequence
cgauucagucaucuccacaaac

SEQ ID NO: 9363 - RNA, 22 nt, Artificial Sequence
  Guide Sequence
cgcacuaacagagcccggcccc

SEQ ID NO: 9364 - RNA, 22 nt, Artificial Sequence
  Guide Sequence
cgcauccuaaaccgugguaccc

SEQ ID NO: 9365 - RNA, 22 nt, Artificial Sequence
  Guide Sequence
cgcccacggccucucuggaucg

SEQ ID NO: 9366 - RNA, 22 nt, Artificial Sequence
  Guide Sequence
cgcuccagcgcauccuaaaccg

SEQ ID NO: 9367 - RNA, 22 nt, Artificial Sequence
  Guide Sequence
cgcugaaaggagccacggaggc

SEQ ID NO: 9368 - RNA, 22 nt, Artificial Sequence
  Guide Sequence
cggaacacaagccaggccucac

SEQ ID NO: 9369 - RNA, 22 nt, Artificial Sequence
  Guide Sequence
cggaccccaccccaauccuuuc

SEQ ID NO: 9370 - RNA, 22 nt, Artificial Sequence
  Guide Sequence
cggcaaacacuggggcucagau

SEQ ID NO: 9371 - RNA, 22 nt, Artificial Sequence
  Guide Sequence
cggccccugcgugugaggaucc

SEQ ID NO: 9372 - RNA, 22 nt, Artificial Sequence
  Guide Sequence
cggccccuucaacgccgggcuc

SEQ ID NO: 9373 - RNA, 22 nt, Artificial Sequence
  Guide Sequence
cggccucucuggaucgcacuaa

SEQ ID NO: 9374 - RNA, 22 nt, Artificial Sequence
  Guide Sequence
cggcuccugcgggucugaagga

SEQ ID NO: 9375 - RNA, 22 nt, Artificial Sequence
  Guide Sequence
cgggucugaaggagcucaccga

SEQ ID NO: 9376 - RNA, 22 nt, Artificial Sequence
  Guide Sequence
cgugguaccccccguuacuucc

SEQ ID NO: 9377 - RNA, 22 nt, Artificial Sequence
  Guide Sequence
cgugugaggauccugcgcgacc

SEQ ID NO: 9378 - RNA, 22 nt, Artificial Sequence
  Guide Sequence
cguuacuucccacggccccuuc

SEQ ID NO: 9379 - RNA, 22 nt, Artificial Sequence
  Guide Sequence
cguuuugaaccucaguccccaa

SEQ ID NO: 9380 - RNA, 22 nt, Artificial Sequence
  Guide Sequence
cuaaaccgugguaccccccguu

SEQ ID NO: 9381 - RNA, 22 nt, Artificial Sequence
  Guide Sequence
cuaacagagcccggccccugcg

SEQ ID NO: 9382 - RNA, 22 nt, Artificial Sequence
  Guide Sequence
cuaccccauaucccaaaugccc

SEQ ID NO: 9383 - RNA, 22 nt, Artificial Sequence
  Guide Sequence
cuaugcugugcccagaguacaa

SEQ ID NO: 9384 - RNA, 22 nt, Artificial Sequence
  Guide Sequence
cucaacacaacuaugcugugcc

SEQ ID NO: 9385 - RNA, 22 nt, Artificial Sequence
  Guide Sequence
cucaccgacgcccacggccucu

SEQ ID NO: 9386 - RNA, 22 nt, Artificial Sequence
  Guide Sequence
cucacgcugaaaggagccacgg

SEQ ID NO: 9387 - RNA, 22 nt, Artificial Sequence
  Guide Sequence
cucagaugggcaggccaaggcg

SEQ ID NO: 9388 - RNA, 22 nt, Artificial Sequence
  Guide Sequence
cuccacaaacuaccccauaucc

SEQ ID NO: 9389 - RNA, 22 nt, Artificial Sequence
  Guide Sequence
cuccacccguuuugaaccucag

SEQ ID NO: 9390 - RNA, 22 nt, Artificial Sequence
  Guide Sequence
cuccagcgcauccuaaaccgug

SEQ ID NO: 9391 - RNA, 22 nt, Artificial Sequence
  Guide Sequence
cuccccucaacacaacuaugcu

SEQ ID NO: 9392 - RNA, 22 nt, Artificial Sequence
  Guide Sequence
cuccggcuccugcgggucugaa

SEQ ID NO: 9393 - RNA, 22 nt, Artificial Sequence
  Guide Sequence
cuccugcgggucugaaggagcu

SEQ ID NO: 9394 - RNA, 22 nt, Artificial Sequence
  Guide Sequence
cucucuggaucgcacuaacaga

SEQ ID NO: 9395 - RNA, 22 nt, Artificial Sequence
  Guide Sequence
cucuggaucgcacuaacagagc

SEQ ID NO: 9396 - RNA, 22 nt, Artificial Sequence
  Guide Sequence
cugaaaggagccacggaggccc

SEQ ID NO: 9397 - RNA, 22 nt, Artificial Sequence
  Guide Sequence
cugaaggagcucaccgacgccc

SEQ ID NO: 9398 - RNA, 22 nt, Artificial Sequence
  Guide Sequence
cugagggagaaagucaagcaug

SEQ ID NO: 9399 - RNA, 22 nt, Artificial Sequence
  Guide Sequence
cugccaagagcacggaccccac

SEQ ID NO: 9400 - RNA, 22 nt, Artificial Sequence
  Guide Sequence
cugcgggucugaaggagcucac

SEQ ID NO: 9401 - RNA, 22 nt, Artificial Sequence
  Guide Sequence
cugcgugugaggauccugcgcg

SEQ ID NO: 9402 - RNA, 22 nt, Artificial Sequence
  Guide Sequence
cuggaaccggaacacaagccag

SEQ ID NO: 9403 - RNA, 22 nt, Artificial Sequence
  Guide Sequence
cuggaucgcacuaacagagccc

SEQ ID NO: 9404 - RNA, 22 nt, Artificial Sequence
  Guide Sequence
cuggcagagacgacugccaaga

SEQ ID NO: 9405 - RNA, 22 nt, Artificial Sequence
  Guide Sequence
cuggggcucagaugggcaggcc

SEQ ID NO: 9406 - RNA, 22 nt, Artificial Sequence
  Guide Sequence
cugugcccagaguacaaagaga

SEQ ID NO: 9407 - RNA, 22 nt, Artificial Sequence
  Guide Sequence
cuucaacgccgggcuccggcuc

SEQ ID NO: 9408 - RNA, 22 nt, Artificial Sequence
  Guide Sequence
cuucccacggccccuucaacgc

SEQ ID NO: 9409 - RNA, 22 nt, Artificial Sequence
  Guide Sequence
cuuucgcuccagcgcauccuaa

SEQ ID NO: 9410 - RNA, 22 nt, Artificial Sequence
  Guide Sequence
gaaaagcacgauucagucaucu

SEQ ID NO: 9411 - RNA, 22 nt, Artificial Sequence
  Guide Sequence
gaaaggagccacggaggcccca

SEQ ID NO: 9412 - RNA, 22 nt, Artificial Sequence
  Guide Sequence
gaaagucaagcaugugaacaca

SEQ ID NO: 9413 - RNA, 22 nt, Artificial Sequence
  Guide Sequence
gaacacaagccaggccucacgc

SEQ ID NO: 9414 - RNA, 22 nt, Artificial Sequence
  Guide Sequence
gaacacaggccuggcagagacg

SEQ ID NO: 9415 - RNA, 22 nt, Artificial Sequence
  Guide Sequence
gaaccggaacacaagccaggcc

SEQ ID NO: 9416 - RNA, 22 nt, Artificial Sequence
  Guide Sequence
gaaggagcucaccgacgcccac

SEQ ID NO: 9417 - RNA, 22 nt, Artificial Sequence
  Guide Sequence
gacagccuccacccguuuugaa

SEQ ID NO: 9418 - RNA, 22 nt, Artificial Sequence
  Guide Sequence
gaccccaccccaauccuuucgc

SEQ ID NO: 9419 - RNA, 22 nt, Artificial Sequence
  Guide Sequence
gacgacugccaagagcacggac

SEQ ID NO: 9420 - RNA, 22 nt, Artificial Sequence
  Guide Sequence
gacgcccacggccucucuggau

SEQ ID NO: 9421 - RNA, 22 nt, Artificial Sequence
  Guide Sequence
gacugccaagagcacggacccc

SEQ ID NO: 9422 - RNA, 22 nt, Artificial Sequence
  Guide Sequence
gagaaagucaagcaugugaaca

SEQ ID NO: 9423 - RNA, 22 nt, Artificial Sequence
  Guide Sequence
gagacgacugccaagagcacgg

SEQ ID NO: 9424 - RNA, 22 nt, Artificial Sequence
  Guide Sequence
gagaggcuggaaccggaacaca

SEQ ID NO: 9425 - RNA, 22 nt, Artificial Sequence
  Guide Sequence
gagcacggaccccaccccaauc

SEQ ID NO: 9426 - RNA, 22 nt, Artificial Sequence
  Guide Sequence
gagccacggaggccccaaacaa

SEQ ID NO: 9427 - RNA, 22 nt, Artificial Sequence
  Guide Sequence
gagcccggccccugcgugugag

SEQ ID NO: 9428 - RNA, 22 nt, Artificial Sequence
  Guide Sequence
gagcucaccgacgcccacggcc

SEQ ID NO: 9429 - RNA, 22 nt, Artificial Sequence
  Guide Sequence
gaggcuggaaccggaacacaag

SEQ ID NO: 9430 - RNA, 22 nt, Artificial Sequence
  Guide Sequence
gagggagaaagucaagcaugug

SEQ ID NO: 9431 - RNA, 22 nt, Artificial Sequence
  Guide Sequence
gaguacaaagagaggcuggaac

SEQ ID NO: 9432 - RNA, 22 nt, Artificial Sequence
  Guide Sequence
gaucgcacuaacagagcccggc

SEQ ID NO: 9433 - RNA, 22 nt, Artificial Sequence
  Guide Sequence
gaugggcaggccaaggcgacag

SEQ ID NO: 9434 - RNA, 22 nt, Artificial Sequence
  Guide Sequence
gauucagucaucuccacaaacu

SEQ ID NO: 9435 - RNA, 22 nt, Artificial Sequence
  Guide Sequence
gcaaacacuggggcucagaugg

SEQ ID NO: 9436 - RNA, 22 nt, Artificial Sequence
  Guide Sequence
gcacgauucagucaucuccaca

SEQ ID NO: 9437 - RNA, 22 nt, Artificial Sequence
  Guide Sequence
gcacggaccccaccccaauccu

SEQ ID NO: 9438 - RNA, 22 nt, Artificial Sequence
  Guide Sequence
gcacuaacagagcccggccccu

SEQ ID NO: 9439 - RNA, 22 nt, Artificial Sequence
  Guide Sequence
gcagagacgacugccaagagca

SEQ ID NO: 9440 - RNA, 22 nt, Artificial Sequence
  Guide Sequence
gcaggccaaggcgacagccucc

SEQ ID NO: 9441 - RNA, 22 nt, Artificial Sequence
  Guide Sequence
gcauccuaaaccgugguacccc

SEQ ID NO: 9442 - RNA, 22 nt, Artificial Sequence
  Guide Sequence
gcaugugaacacaggccuggca

SEQ ID NO: 9443 - RNA, 22 nt, Artificial Sequence
  Guide Sequence
gccaagagcacggaccccaccc

SEQ ID NO: 9444 - RNA, 22 nt, Artificial Sequence
  Guide Sequence
gccaaggcgacagccuccaccc

SEQ ID NO: 9445 - RNA, 22 nt, Artificial Sequence
  Guide Sequence
gccaggccucacgcugaaagga

SEQ ID NO: 9446 - RNA, 22 nt, Artificial Sequence
  Guide Sequence
gcccacggccucucuggaucgc

SEQ ID NO: 9447 - RNA, 22 nt, Artificial Sequence
  Guide Sequence
gcccagaguacaaagagaggcu

SEQ ID NO: 9448 - RNA, 22 nt, Artificial Sequence
  Guide Sequence
gccccugcgugugaggauccug

SEQ ID NO: 9449 - RNA, 22 nt, Artificial Sequence
  Guide Sequence
gccccuucaacgccgggcuccg

SEQ ID NO: 9450 - RNA, 22 nt, Artificial Sequence
  Guide Sequence
gcccggccccugcgugugagga

SEQ ID NO: 9451 - RNA, 22 nt, Artificial Sequence
  Guide Sequence
gcccuccccucaacacaacuau

SEQ ID NO: 9452 - RNA, 22 nt, Artificial Sequence
  Guide Sequence
gccucacgcugaaaggagccac

SEQ ID NO: 9453 - RNA, 22 nt, Artificial Sequence
  Guide Sequence
gccuccacccguuuugaaccuc

SEQ ID NO: 9454 - RNA, 22 nt, Artificial Sequence
  Guide Sequence
gccucucuggaucgcacuaaca

SEQ ID NO: 9455 - RNA, 22 nt, Artificial Sequence
  Guide Sequence
gccuggcagagacgacugccaa

SEQ ID NO: 9456 - RNA, 22 nt, Artificial Sequence
  Guide Sequence
gcgacagccuccacccguuuug

SEQ ID NO: 9457 - RNA, 22 nt, Artificial Sequence
  Guide Sequence
gcgcauccuaaaccgugguacc

SEQ ID NO: 9458 - RNA, 22 nt, Artificial Sequence
  Guide Sequence
gcgggucugaaggagcucaccg

SEQ ID NO: 9459 - RNA, 22 nt, Artificial Sequence
  Guide Sequence
gcgugugaggauccugcgcgac

SEQ ID NO: 9460 - RNA, 22 nt, Artificial Sequence
  Guide Sequence
gcucaccgacgcccacggccuc

SEQ ID NO: 9461 - RNA, 22 nt, Artificial Sequence
  Guide Sequence
gcucagaugggcaggccaaggc

SEQ ID NO: 9462 - RNA, 22 nt, Artificial Sequence
  Guide Sequence
gcuccagcgcauccuaaaccgu

SEQ ID NO: 9463 - RNA, 22 nt, Artificial Sequence
  Guide Sequence
gcuccggcuccugcgggucuga

SEQ ID NO: 9464 - RNA, 22 nt, Artificial Sequence
  Guide Sequence
gcuccugcgggucugaaggagc

SEQ ID NO: 9465 - RNA, 22 nt, Artificial Sequence
  Guide Sequence
gcugaaaggagccacggaggcc

SEQ ID NO: 9466 - RNA, 22 nt, Artificial Sequence
  Guide Sequence
gcuggaaccggaacacaagcca

SEQ ID NO: 9467 - RNA, 22 nt, Artificial Sequence
  Guide Sequence
gcugugcccagaguacaaagag

SEQ ID NO: 9468 - RNA, 22 nt, Artificial Sequence
  Guide Sequence
ggaaaagcacgauucagucauc

SEQ ID NO: 9469 - RNA, 22 nt, Artificial Sequence
  Guide Sequence
ggaacacaagccaggccucacg

SEQ ID NO: 9470 - RNA, 22 nt, Artificial Sequence
  Guide Sequence
ggaaccggaacacaagccaggc

SEQ ID NO: 9471 - RNA, 22 nt, Artificial Sequence
  Guide Sequence
ggaccccaccccaauccuuucg

SEQ ID NO: 9472 - RNA, 22 nt, Artificial Sequence
  Guide Sequence
ggagaaagucaagcaugugaac

SEQ ID NO: 9473 - RNA, 22 nt, Artificial Sequence
  Guide Sequence
ggagccacggaggccccaaaca

SEQ ID NO: 9474 - RNA, 22 nt, Artificial Sequence
  Guide Sequence
ggagcucaccgacgcccacggc

SEQ ID NO: 9475 - RNA, 22 nt, Artificial Sequence
  Guide Sequence
ggaucgcacuaacagagcccgg

SEQ ID NO: 9476 - RNA, 22 nt, Artificial Sequence
  Guide Sequence
ggcaaacacuggggcucagaug

SEQ ID NO: 9477 - RNA, 22 nt, Artificial Sequence
  Guide Sequence
ggcagagacgacugccaagagc

SEQ ID NO: 9478 - RNA, 22 nt, Artificial Sequence
  Guide Sequence
ggcaggccaaggcgacagccuc

SEQ ID NO: 9479 - RNA, 22 nt, Artificial Sequence
  Guide Sequence
ggccaaggcgacagccuccacc

SEQ ID NO: 9480 - RNA, 22 nt, Artificial Sequence
  Guide Sequence
ggccccugcgugugaggauccu

SEQ ID NO: 9481 - RNA, 22 nt, Artificial Sequence
  Guide Sequence
ggccccuucaacgccgggcucc

SEQ ID NO: 9482 - RNA, 22 nt, Artificial Sequence
  Guide Sequence
ggccucacgcugaaaggagcca

SEQ ID NO: 9483 - RNA, 22 nt, Artificial Sequence
  Guide Sequence
ggccucucuggaucgcacuaac

SEQ ID NO: 9484 - RNA, 22 nt, Artificial Sequence
  Guide Sequence
ggccuggcagagacgacugcca

SEQ ID NO: 9485 - RNA, 22 nt, Artificial Sequence
  Guide Sequence
ggcgacagccuccacccguuuu

SEQ ID NO: 9486 - RNA, 22 nt, Artificial Sequence
  Guide Sequence
ggcucagaugggcaggccaagg

SEQ ID NO: 9487 - RNA, 22 nt, Artificial Sequence
  Guide Sequence
ggcuccggcuccugcgggucug

SEQ ID NO: 9488 - RNA, 22 nt, Artificial Sequence
  Guide Sequence
ggcuccugcgggucugaaggag

SEQ ID NO: 9489 - RNA, 22 nt, Artificial Sequence
  Guide Sequence
ggcuggaaccggaacacaagcc

SEQ ID NO: 9490 - RNA, 22 nt, Artificial Sequence
  Guide Sequence
gggaaaagcacgauucagucau

SEQ ID NO: 9491 - RNA, 22 nt, Artificial Sequence
  Guide Sequence
gggagaaagucaagcaugugaa

SEQ ID NO: 9492 - RNA, 22 nt, Artificial Sequence
  Guide Sequence
gggcaggccaaggcgacagccu

SEQ ID NO: 9493 - RNA, 22 nt, Artificial Sequence
  Guide Sequence
gggcucagaugggcaggccaag

SEQ ID NO: 9494 - RNA, 22 nt, Artificial Sequence
  Guide Sequence
gggcuccggcuccugcgggucu

SEQ ID NO: 9495 - RNA, 22 nt, Artificial Sequence
  Guide Sequence
ggggcucagaugggcaggccaa

SEQ ID NO: 9496 - RNA, 22 nt, Artificial Sequence
  Guide Sequence
gggucugaaggagcucaccgac

SEQ ID NO: 9497 - RNA, 22 nt, Artificial Sequence
  Guide Sequence
gguaccccccguuacuucccac

SEQ ID NO: 9498 - RNA, 22 nt, Artificial Sequence
  Guide Sequence
ggucugaaggagcucaccgacg

SEQ ID NO: 9499 - RNA, 22 nt, Artificial Sequence
  Guide Sequence
guacaaagagaggcuggaaccg

SEQ ID NO: 9500 - RNA, 22 nt, Artificial Sequence
  Guide Sequence
guaccccccguuacuucccacg

SEQ ID NO: 9501 - RNA, 22 nt, Artificial Sequence
  Guide Sequence
gucaagcaugugaacacaggcc

SEQ ID NO: 9502 - RNA, 22 nt, Artificial Sequence
  Guide Sequence
gucaucuccacaaacuacccca

SEQ ID NO: 9503 - RNA, 22 nt, Artificial Sequence
  Guide Sequence
gucugaaggagcucaccgacgc

SEQ ID NO: 9504 - RNA, 22 nt, Artificial Sequence
  Guide Sequence
gugaacacaggccuggcagaga

SEQ ID NO: 9505 - RNA, 22 nt, Artificial Sequence
  Guide Sequence
gugaggauccugcgcgacccca

SEQ ID NO: 9506 - RNA, 22 nt, Artificial Sequence
  Guide Sequence
gugcccagaguacaaagagagg

SEQ ID NO: 9507 - RNA, 22 nt, Artificial Sequence
  Guide Sequence
gugguaccccccguuacuuccc

SEQ ID NO: 9508 - RNA, 22 nt, Artificial Sequence
  Guide Sequence
gugugaggauccugcgcgaccc

SEQ ID NO: 9509 - RNA, 22 nt, Artificial Sequence
  Guide Sequence
guuacuucccacggccccuuca

SEQ ID NO: 9510 - RNA, 22 nt, Artificial Sequence
  Guide Sequence
guuuugaaccucaguccccaaa

SEQ ID NO: 9511 - RNA, 22 nt, Artificial Sequence
  Guide Sequence
uaaaccgugguaccccccguua

SEQ ID NO: 9512 - RNA, 22 nt, Artificial Sequence
  Guide Sequence
uaacagagcccggccccugcgu

SEQ ID NO: 9513 - RNA, 22 nt, Artificial Sequence
  Guide Sequence
uacaaagagaggcuggaaccgg

SEQ ID NO: 9514 - RNA, 22 nt, Artificial Sequence
  Guide Sequence
uaccccauaucccaaaugcccu

SEQ ID NO: 9515 - RNA, 22 nt, Artificial Sequence
  Guide Sequence
uaccccccguuacuucccacgg

SEQ ID NO: 9516 - RNA, 22 nt, Artificial Sequence
  Guide Sequence
uacuucccacggccccuucaac

SEQ ID NO: 9517 - RNA, 22 nt, Artificial Sequence
  Guide Sequence
uaucccaaaugcccuccccuca

SEQ ID NO: 9518 - RNA, 22 nt, Artificial Sequence
  Guide Sequence
uaugcugugcccagaguacaaa

SEQ ID NO: 9519 - RNA, 22 nt, Artificial Sequence
  Guide Sequence
ucaacacaacuaugcugugccc

SEQ ID NO: 9520 - RNA, 22 nt, Artificial Sequence
  Guide Sequence
ucaacgccgggcuccggcuccu

SEQ ID NO: 9521 - RNA, 22 nt, Artificial Sequence
  Guide Sequence
ucaagcaugugaacacaggccu

SEQ ID NO: 9522 - RNA, 22 nt, Artificial Sequence
  Guide Sequence
ucaccgacgcccacggccucuc

SEQ ID NO: 9523 - RNA, 22 nt, Artificial Sequence
  Guide Sequence
ucacgcugaaaggagccacgga

SEQ ID NO: 9524 - RNA, 22 nt, Artificial Sequence
  Guide Sequence
ucagaugggcaggccaaggcga

SEQ ID NO: 9525 - RNA, 22 nt, Artificial Sequence
  Guide Sequence
ucagucaucuccacaaacuacc

SEQ ID NO: 9526 - RNA, 22 nt, Artificial Sequence
  Guide Sequence
ucaucuccacaaacuaccccau

SEQ ID NO: 9527 - RNA, 22 nt, Artificial Sequence
  Guide Sequence
uccacaaacuaccccauauccc

SEQ ID NO: 9528 - RNA, 22 nt, Artificial Sequence
  Guide Sequence
uccagcgcauccuaaaccgugg

SEQ ID NO: 9529 - RNA, 22 nt, Artificial Sequence
  Guide Sequence
ucccaaaugcccuccccucaac

SEQ ID NO: 9530 - RNA, 22 nt, Artificial Sequence
  Guide Sequence
ucccacggccccuucaacgccg

SEQ ID NO: 9531 - RNA, 22 nt, Artificial Sequence
  Guide Sequence
uccccucaacacaacuaugcug

SEQ ID NO: 9532 - RNA, 22 nt, Artificial Sequence
  Guide Sequence
uccggcuccugcgggucugaag

SEQ ID NO: 9533 - RNA, 22 nt, Artificial Sequence
  Guide Sequence
uccuaaaccgugguaccccccg

SEQ ID NO: 9534 - RNA, 22 nt, Artificial Sequence
  Guide Sequence
uccugcgggucugaaggagcuc

SEQ ID NO: 9535 - RNA, 22 nt, Artificial Sequence
  Guide Sequence
uccuuucgcuccagcgcauccu

SEQ ID NO: 9536 - RNA, 22 nt, Artificial Sequence
  Guide Sequence
ucgcacuaacagagcccggccc

SEQ ID NO: 9537 - RNA, 22 nt, Artificial Sequence
  Guide Sequence
ucgcuccagcgcauccuaaacc

SEQ ID NO: 9538 - RNA, 22 nt, Artificial Sequence
  Guide Sequence
ucuccacaaacuaccccauauc

SEQ ID NO: 9539 - RNA, 22 nt, Artificial Sequence
  Guide Sequence
ucucuggaucgcacuaacagag

SEQ ID NO: 9540 - RNA, 22 nt, Artificial Sequence
  Guide Sequence
ucugaaggagcucaccgacgcc

SEQ ID NO: 9541 - RNA, 22 nt, Artificial Sequence
  Guide Sequence
ucuggaucgcacuaacagagcc

SEQ ID NO: 9542 - RNA, 22 nt, Artificial Sequence
  Guide Sequence
ugaaaggagccacggaggcccc

SEQ ID NO: 9543 - RNA, 22 nt, Artificial Sequence
  Guide Sequence
ugaacacaggccuggcagagac

SEQ ID NO: 9544 - RNA, 22 nt, Artificial Sequence
  Guide Sequence
ugaaggagcucaccgacgccca

SEQ ID NO: 9545 - RNA, 22 nt, Artificial Sequence
  Guide Sequence
ugaggauccugcgcgaccccac

SEQ ID NO: 9546 - RNA, 22 nt, Artificial Sequence
  Guide Sequence
ugagggagaaagucaagcaugu

SEQ ID NO: 9547 - RNA, 22 nt, Artificial Sequence
  Guide Sequence
ugccaagagcacggaccccacc

SEQ ID NO: 9548 - RNA, 22 nt, Artificial Sequence
  Guide Sequence
ugcccagaguacaaagagaggc

SEQ ID NO: 9549 - RNA, 22 nt, Artificial Sequence
  Guide Sequence
ugcccuccccucaacacaacua

SEQ ID NO: 9550 - RNA, 22 nt, Artificial Sequence
  Guide Sequence
ugcgggucugaaggagcucacc

SEQ ID NO: 9551 - RNA, 22 nt, Artificial Sequence
  Guide Sequence
ugcgugugaggauccugcgcga

SEQ ID NO: 9552 - RNA, 22 nt, Artificial Sequence
  Guide Sequence
ugcugugcccagaguacaaaga

SEQ ID NO: 9553 - RNA, 22 nt, Artificial Sequence
  Guide Sequence
uggaaccggaacacaagccagg

SEQ ID NO: 9554 - RNA, 22 nt, Artificial Sequence
  Guide Sequence
uggaucgcacuaacagagcccg

SEQ ID NO: 9555 - RNA, 22 nt, Artificial Sequence
  Guide Sequence
uggcagagacgacugccaagag

SEQ ID NO: 9556 - RNA, 22 nt, Artificial Sequence
  Guide Sequence
ugggcaggccaaggcgacagcc

SEQ ID NO: 9557 - RNA, 22 nt, Artificial Sequence
  Guide Sequence
uggggcucagaugggcaggcca

SEQ ID NO: 9558 - RNA, 22 nt, Artificial Sequence
  Guide Sequence
ugguaccccccguuacuuccca

SEQ ID NO: 9559 - RNA, 22 nt, Artificial Sequence
  Guide Sequence
ugugaacacaggccuggcagag

SEQ ID NO: 9560 - RNA, 22 nt, Artificial Sequence
  Guide Sequence
ugugaggauccugcgcgacccc

SEQ ID NO: 9561 - RNA, 22 nt, Artificial Sequence
  Guide Sequence
ugugcccagaguacaaagagag

SEQ ID NO: 9562 - RNA, 22 nt, Artificial Sequence
  Guide Sequence
uuacuucccacggccccuucaa

SEQ ID NO: 9563 - RNA, 22 nt, Artificial Sequence
  Guide Sequence
uucaacgccgggcuccggcucc

SEQ ID NO: 9564 - RNA, 22 nt, Artificial Sequence
  Guide Sequence
uucagucaucuccacaaacuac

SEQ ID NO: 9565 - RNA, 22 nt, Artificial Sequence
  Guide Sequence
uucccacggccccuucaacgcc

SEQ ID NO: 9566 - RNA, 22 nt, Artificial Sequence
  Guide Sequence
uucgcuccagcgcauccuaaac

SEQ ID NO: 9567 - RNA, 22 nt, Artificial Sequence
  Guide Sequence
uuucgcuccagcgcauccuaaa

SEQ ID NO: 9568 - RNA, 22 nt, Artificial Sequence
  Guide Sequence
uuuugaaccucaguccccaaac

SEQ ID NO: 9569 - RNA, 20 nt, Artificial Sequence
  Guide Sequence
aaaaacuuggaguaccaagu

SEQ ID NO: 9570 - RNA, 20 nt, Artificial Sequence
  Guide Sequence
aaaacagugggaaaagcacg

SEQ ID NO: 9571 - RNA, 20 nt, Artificial Sequence
  Guide Sequence
aaaacuuggaguaccaaguu

SEQ ID NO: 9572 - RNA, 20 nt, Artificial Sequence
  Guide Sequence
aaacagugggaaaagcacga

SEQ ID NO: 9573 - RNA, 20 nt, Artificial Sequence
  Guide Sequence
aaacuuggaguaccaaguua

SEQ ID NO: 9574 - RNA, 20 nt, Artificial Sequence
  Guide Sequence
aaagagcucagaggagacag

SEQ ID NO: 9575 - RNA, 20 nt, Artificial Sequence
  Guide Sequence
aaagcaaguggugacacaac

SEQ ID NO: 9576 - RNA, 20 nt, Artificial Sequence
  Guide Sequence
aaagccacagguccuccucu

SEQ ID NO: 9577 - RNA, 20 nt, Artificial Sequence
  Guide Sequence
aaagcucuuagaaugucaua

SEQ ID NO: 9578 - RNA, 20 nt, Artificial Sequence
  Guide Sequence
aacagugggaaaagcacgau

SEQ ID NO: 9579 - RNA, 20 nt, Artificial Sequence
  Guide Sequence
aaccaaggguuucucucccu

SEQ ID NO: 9580 - RNA, 20 nt, Artificial Sequence
  Guide Sequence
aacuuggaguaccaaguuau

SEQ ID NO: 9581 - RNA, 20 nt, Artificial Sequence
  Guide Sequence
aagaccaaaacagugggaaa

SEQ ID NO: 9582 - RNA, 20 nt, Artificial Sequence
  Guide Sequence
aagagcucagaggagacagg

SEQ ID NO: 9583 - RNA, 20 nt, Artificial Sequence
  Guide Sequence
aagcaaguggugacacaacc

SEQ ID NO: 9584 - RNA, 20 nt, Artificial Sequence
  Guide Sequence
aagccacagguccuccucuc

SEQ ID NO: 9585 - RNA, 20 nt, Artificial Sequence
  Guide Sequence
aagcucuuagaaugucauaa

SEQ ID NO: 9586 - RNA, 20 nt, Artificial Sequence
  Guide Sequence
aaggguuucucucccucuug

SEQ ID NO: 9587 - RNA, 20 nt, Artificial Sequence
  Guide Sequence
aaguaugguuugugccaggg

SEQ ID NO: 9588 - RNA, 20 nt, Artificial Sequence
  Guide Sequence
aaguggugacacaaccaagg

SEQ ID NO: 9589 - RNA, 20 nt, Artificial Sequence
  Guide Sequence
aaguuaucgaaugucacauc

SEQ ID NO: 9590 - RNA, 20 nt, Artificial Sequence
  Guide Sequence
aaugucacaucacacaaagc

SEQ ID NO: 9591 - RNA, 20 nt, Artificial Sequence
  Guide Sequence
aaugucauaaaaacuuggag

SEQ ID NO: 9592 - RNA, 20 nt, Artificial Sequence
  Guide Sequence
acaaagcaaguggugacaca

SEQ ID NO: 9593 - RNA, 20 nt, Artificial Sequence
  Guide Sequence
acaaagcucuuagaauguca

SEQ ID NO: 9594 - RNA, 20 nt, Artificial Sequence
  Guide Sequence
acaaccaaggguuucucucc

SEQ ID NO: 9595 - RNA, 20 nt, Artificial Sequence
  Guide Sequence
acacaaagcaaguggugaca

SEQ ID NO: 9596 - RNA, 20 nt, Artificial Sequence
  Guide Sequence
acacaaccaaggguuucucu

SEQ ID NO: 9597 - RNA, 20 nt, Artificial Sequence
  Guide Sequence
acagggaaguaugguuugug

SEQ ID NO: 9598 - RNA, 20 nt, Artificial Sequence
  Guide Sequence
acagguccuccucucacaaa

SEQ ID NO: 9599 - RNA, 20 nt, Artificial Sequence
  Guide Sequence
acagugggaaaagcacgauu

SEQ ID NO: 9600 - RNA, 20 nt, Artificial Sequence
  Guide Sequence
acaucacacaaagcaagugg

SEQ ID NO: 9601 - RNA, 20 nt, Artificial Sequence
  Guide Sequence
acauucaucugucucugguu

SEQ ID NO: 9602 - RNA, 20 nt, Artificial Sequence
  Guide Sequence
accaaaacagugggaaaagc

SEQ ID NO: 9603 - RNA, 20 nt, Artificial Sequence
  Guide Sequence
accaaggguuucucucccuc

SEQ ID NO: 9604 - RNA, 20 nt, Artificial Sequence
  Guide Sequence
accaaguuaucgaaugucac

SEQ ID NO: 9605 - RNA, 20 nt, Artificial Sequence
  Guide Sequence
acccagcuccccacucucca

SEQ ID NO: 9606 - RNA, 20 nt, Artificial Sequence
  Guide Sequence
acucuccagccaaagaccua

SEQ ID NO: 9607 - RNA, 20 nt, Artificial Sequence
  Guide Sequence
acuuggaguaccaaguuauc

SEQ ID NO: 9608 - RNA, 20 nt, Artificial Sequence
  Guide Sequence
agaaugucauaaaaacuugg

SEQ ID NO: 9609 - RNA, 20 nt, Artificial Sequence
  Guide Sequence
agacagggaaguaugguuug

SEQ ID NO: 9610 - RNA, 20 nt, Artificial Sequence
  Guide Sequence
agaccaaaacagugggaaaa

SEQ ID NO: 9611 - RNA, 20 nt, Artificial Sequence
  Guide Sequence
agagcucagaggagacaggg

SEQ ID NO: 9612 - RNA, 20 nt, Artificial Sequence
  Guide Sequence
agaggagacagggaaguaug

SEQ ID NO: 9613 - RNA, 20 nt, Artificial Sequence
  Guide Sequence
agcaaguggugacacaacca

SEQ ID NO: 9614 - RNA, 20 nt, Artificial Sequence
  Guide Sequence
agccacagguccuccucuca

SEQ ID NO: 9615 - RNA, 20 nt, Artificial Sequence
  Guide Sequence
agcucagaggagacagggaa

SEQ ID NO: 9616 - RNA, 20 nt, Artificial Sequence
  Guide Sequence
agcuccccacucuccagcca

SEQ ID NO: 9617 - RNA, 20 nt, Artificial Sequence
  Guide Sequence
agcucuuagaaugucauaaa

SEQ ID NO: 9618 - RNA, 20 nt, Artificial Sequence
  Guide Sequence
aggagacagggaaguauggu

SEQ ID NO: 9619 - RNA, 20 nt, Artificial Sequence
  Guide Sequence
aggcucaaagccacaggucc

SEQ ID NO: 9620 - RNA, 20 nt, Artificial Sequence
  Guide Sequence
agggaaguaugguuugugcc

SEQ ID NO: 9621 - RNA, 20 nt, Artificial Sequence
  Guide Sequence
aggggucacccagcucccca

SEQ ID NO: 9622 - RNA, 20 nt, Artificial Sequence
  Guide Sequence
aggguuucucucccucuugg

SEQ ID NO: 9623 - RNA, 20 nt, Artificial Sequence
  Guide Sequence
agguccuccucucacaaagc

SEQ ID NO: 9624 - RNA, 20 nt, Artificial Sequence
  Guide Sequence
aguaccaaguuaucgaaugu

SEQ ID NO: 9625 - RNA, 20 nt, Artificial Sequence
  Guide Sequence
aguaugguuugugccagggg

SEQ ID NO: 9626 - RNA, 20 nt, Artificial Sequence
  Guide Sequence
agugggaaaagcacgauuca

SEQ ID NO: 9627 - RNA, 20 nt, Artificial Sequence
  Guide Sequence
aguggugacacaaccaaggg

SEQ ID NO: 9628 - RNA, 20 nt, Artificial Sequence
  Guide Sequence
aguuaucgaaugucacauca

SEQ ID NO: 9629 - RNA, 20 nt, Artificial Sequence
  Guide Sequence
auaaaaacuuggaguaccaa

SEQ ID NO: 9630 - RNA, 20 nt, Artificial Sequence
  Guide Sequence
aucacacaaagcaaguggug

SEQ ID NO: 9631 - RNA, 20 nt, Artificial Sequence
  Guide Sequence
aucgaaugucacaucacaca

SEQ ID NO: 9632 - RNA, 20 nt, Artificial Sequence
  Guide Sequence
aucugucucugguuuccccu

SEQ ID NO: 9633 - RNA, 20 nt, Artificial Sequence
  Guide Sequence
augguuugugccagggguca

SEQ ID NO: 9634 - RNA, 20 nt, Artificial Sequence
  Guide Sequence
augucacaucacacaaagca

SEQ ID NO: 9635 - RNA, 20 nt, Artificial Sequence
  Guide Sequence
augucauaaaaacuuggagu

SEQ ID NO: 9636 - RNA, 20 nt, Artificial Sequence
  Guide Sequence
auucaucugucucugguuuc

SEQ ID NO: 9637 - RNA, 20 nt, Artificial Sequence
  Guide Sequence
caaaacagugggaaaagcac

SEQ ID NO: 9638 - RNA, 20 nt, Artificial Sequence
  Guide Sequence
caaagcaaguggugacacaa

SEQ ID NO: 9639 - RNA, 20 nt, Artificial Sequence
  Guide Sequence
caaagccacagguccuccuc

SEQ ID NO: 9640 - RNA, 20 nt, Artificial Sequence
  Guide Sequence
caaagcucuuagaaugucau

SEQ ID NO: 9641 - RNA, 20 nt, Artificial Sequence
  Guide Sequence
caaccaaggguuucucuccc

SEQ ID NO: 9642 - RNA, 20 nt, Artificial Sequence
  Guide Sequence
caaggguuucucucccucuu

SEQ ID NO: 9643 - RNA, 20 nt, Artificial Sequence
  Guide Sequence
caaguggugacacaaccaag

SEQ ID NO: 9644 - RNA, 20 nt, Artificial Sequence
  Guide Sequence
caaguuaucgaaugucacau

SEQ ID NO: 9645 - RNA, 20 nt, Artificial Sequence
  Guide Sequence
cacaaagcaaguggugacac

SEQ ID NO: 9646 - RNA, 20 nt, Artificial Sequence
  Guide Sequence
cacaaagcucuuagaauguc

SEQ ID NO: 9647 - RNA, 20 nt, Artificial Sequence
  Guide Sequence
cacaaccaaggguuucucuc

SEQ ID NO: 9648 - RNA, 20 nt, Artificial Sequence
  Guide Sequence
cacacaaagcaaguggugac

SEQ ID NO: 9649 - RNA, 20 nt, Artificial Sequence
  Guide Sequence
cacagguccuccucucacaa

SEQ ID NO: 9650 - RNA, 20 nt, Artificial Sequence
  Guide Sequence
cacaucacacaaagcaagug

SEQ ID NO: 9651 - RNA, 20 nt, Artificial Sequence
  Guide Sequence
cacccagcuccccacucucc

SEQ ID NO: 9652 - RNA, 20 nt, Artificial Sequence
  Guide Sequence
cacucuccagccaaagaccu

SEQ ID NO: 9653 - RNA, 20 nt, Artificial Sequence
  Guide Sequence
cagaggagacagggaaguau

SEQ ID NO: 9654 - RNA, 20 nt, Artificial Sequence
  Guide Sequence
cagccaaagaccuaaguucc

SEQ ID NO: 9655 - RNA, 20 nt, Artificial Sequence
  Guide Sequence
cagcuccccacucuccagcc

SEQ ID NO: 9656 - RNA, 20 nt, Artificial Sequence
  Guide Sequence
cagggaaguaugguuugugc

SEQ ID NO: 9657 - RNA, 20 nt, Artificial Sequence
  Guide Sequence
caggggucacccagcucccc

SEQ ID NO: 9658 - RNA, 20 nt, Artificial Sequence
  Guide Sequence
cagguccuccucucacaaag

SEQ ID NO: 9659 - RNA, 20 nt, Artificial Sequence
  Guide Sequence
cagugggaaaagcacgauuc

SEQ ID NO: 9660 - RNA, 20 nt, Artificial Sequence
  Guide Sequence
cauaaaaacuuggaguacca

SEQ ID NO: 9661 - RNA, 20 nt, Artificial Sequence
  Guide Sequence
caucacacaaagcaaguggu

SEQ ID NO: 9662 - RNA, 20 nt, Artificial Sequence
  Guide Sequence
caucugucucugguuucccc

SEQ ID NO: 9663 - RNA, 20 nt, Artificial Sequence
  Guide Sequence
cauucaucugucucugguuu

SEQ ID NO: 9664 - RNA, 20 nt, Artificial Sequence
  Guide Sequence
ccaaaacagugggaaaagca

SEQ ID NO: 9665 - RNA, 20 nt, Artificial Sequence
  Guide Sequence
ccaaggguuucucucccucu

SEQ ID NO: 9666 - RNA, 20 nt, Artificial Sequence
  Guide Sequence
ccaaguuaucgaaugucaca

SEQ ID NO: 9667 - RNA, 20 nt, Artificial Sequence
  Guide Sequence
ccacagguccuccucucaca

SEQ ID NO: 9668 - RNA, 20 nt, Artificial Sequence
  Guide Sequence
ccacucuccagccaaagacc

SEQ ID NO: 9669 - RNA, 20 nt, Artificial Sequence
  Guide Sequence
ccagcuccccacucuccagc

SEQ ID NO: 9670 - RNA, 20 nt, Artificial Sequence
  Guide Sequence
ccaggggucacccagcuccc

SEQ ID NO: 9671 - RNA, 20 nt, Artificial Sequence
  Guide Sequence
cccacucuccagccaaagac

SEQ ID NO: 9672 - RNA, 20 nt, Artificial Sequence
  Guide Sequence
cccagcuccccacucuccag

SEQ ID NO: 9673 - RNA, 20 nt, Artificial Sequence
  Guide Sequence
ccccacucuccagccaaaga

SEQ ID NO: 9674 - RNA, 20 nt, Artificial Sequence
  Guide Sequence
ccccugaggcucaaagccac

SEQ ID NO: 9675 - RNA, 20 nt, Artificial Sequence
  Guide Sequence
cccucuuggggcgggaaaga

SEQ ID NO: 9676 - RNA, 20 nt, Artificial Sequence
  Guide Sequence
cccugaggcucaaagccaca

SEQ ID NO: 9677 - RNA, 20 nt, Artificial Sequence
  Guide Sequence
ccuccucucacaaagcucuu

SEQ ID NO: 9678 - RNA, 20 nt, Artificial Sequence
  Guide Sequence
ccucucacaaagcucuuaga

SEQ ID NO: 9679 - RNA, 20 nt, Artificial Sequence
  Guide Sequence
ccucuuggggcgggaaagag

SEQ ID NO: 9680 - RNA, 20 nt, Artificial Sequence
  Guide Sequence
ccugaggcucaaagccacag

SEQ ID NO: 9681 - RNA, 20 nt, Artificial Sequence
  Guide Sequence
cgaaugucacaucacacaaa

SEQ ID NO: 9682 - RNA, 20 nt, Artificial Sequence
  Guide Sequence
cgggaaagagcucagaggag

SEQ ID NO: 9683 - RNA, 20 nt, Artificial Sequence
  Guide Sequence
cuaagaccaaaacaguggga

SEQ ID NO: 9684 - RNA, 20 nt, Artificial Sequence
  Guide Sequence
cucaaagccacagguccucc

SEQ ID NO: 9685 - RNA, 20 nt, Artificial Sequence
  Guide Sequence
cucacaaagcucuuagaaug

SEQ ID NO: 9686 - RNA, 20 nt, Artificial Sequence
  Guide Sequence
cucagaggagacagggaagu

SEQ ID NO: 9687 - RNA, 20 nt, Artificial Sequence
  Guide Sequence
cuccccacucuccagccaaa

SEQ ID NO: 9688 - RNA, 20 nt, Artificial Sequence
  Guide Sequence
cucccucuuggggcgggaaa

SEQ ID NO: 9689 - RNA, 20 nt, Artificial Sequence
  Guide Sequence
cuccucucacaaagcucuua

SEQ ID NO: 9690 - RNA, 20 nt, Artificial Sequence
  Guide Sequence
cucucacaaagcucuuagaa

SEQ ID NO: 9691 - RNA, 20 nt, Artificial Sequence
  Guide Sequence
cucuccagccaaagaccuaa

SEQ ID NO: 9692 - RNA, 20 nt, Artificial Sequence
  Guide Sequence
cucucccucuuggggcggga

SEQ ID NO: 9693 - RNA, 20 nt, Artificial Sequence
  Guide Sequence
cucugguuuccccugaggcu

SEQ ID NO: 9694 - RNA, 20 nt, Artificial Sequence
  Guide Sequence
cucuuggggcgggaaagagc

SEQ ID NO: 9695 - RNA, 20 nt, Artificial Sequence
  Guide Sequence
cugaggcucaaagccacagg

SEQ ID NO: 9696 - RNA, 20 nt, Artificial Sequence
  Guide Sequence
cugguuuccccugaggcuca

SEQ ID NO: 9697 - RNA, 20 nt, Artificial Sequence
  Guide Sequence
cugucucugguuuccccuga

SEQ ID NO: 9698 - RNA, 20 nt, Artificial Sequence
  Guide Sequence
cuuggaguaccaaguuaucg

SEQ ID NO: 9699 - RNA, 20 nt, Artificial Sequence
  Guide Sequence
cuuggggcgggaaagagcuc

SEQ ID NO: 9700 - RNA, 20 nt, Artificial Sequence
  Guide Sequence
gaaagagcucagaggagaca

SEQ ID NO: 9701 - RNA, 20 nt, Artificial Sequence
  Guide Sequence
gaaguaugguuugugccagg

SEQ ID NO: 9702 - RNA, 20 nt, Artificial Sequence
  Guide Sequence
gaaugucacaucacacaaag

SEQ ID NO: 9703 - RNA, 20 nt, Artificial Sequence
  Guide Sequence
gaaugucauaaaaacuugga

SEQ ID NO: 9704 - RNA, 20 nt, Artificial Sequence
  Guide Sequence
gacacaaccaaggguuucuc

SEQ ID NO: 9705 - RNA, 20 nt, Artificial Sequence
  Guide Sequence
gacagggaaguaugguuugu

SEQ ID NO: 9706 - RNA, 20 nt, Artificial Sequence
  Guide Sequence
gaccaaaacagugggaaaag

SEQ ID NO: 9707 - RNA, 20 nt, Artificial Sequence
  Guide Sequence
gagacagggaaguaugguuu

SEQ ID NO: 9708 - RNA, 20 nt, Artificial Sequence
  Guide Sequence
gagcucagaggagacaggga

SEQ ID NO: 9709 - RNA, 20 nt, Artificial Sequence
  Guide Sequence
gaggagacagggaaguaugg

SEQ ID NO: 9710 - RNA, 20 nt, Artificial Sequence
  Guide Sequence
gaggcucaaagccacagguc

SEQ ID NO: 9711 - RNA, 20 nt, Artificial Sequence
  Guide Sequence
gaguaccaaguuaucgaaug

SEQ ID NO: 9712 - RNA, 20 nt, Artificial Sequence
  Guide Sequence
gcaaguggugacacaaccaa

SEQ ID NO: 9713 - RNA, 20 nt, Artificial Sequence
  Guide Sequence
gccacagguccuccucucac

SEQ ID NO: 9714 - RNA, 20 nt, Artificial Sequence
  Guide Sequence
gccaggggucacccagcucc

SEQ ID NO: 9715 - RNA, 20 nt, Artificial Sequence
  Guide Sequence
gcgggaaagagcucagagga

SEQ ID NO: 9716 - RNA, 20 nt, Artificial Sequence
  Guide Sequence
gcucaaagccacagguccuc

SEQ ID NO: 9717 - RNA, 20 nt, Artificial Sequence
  Guide Sequence
gcucagaggagacagggaag

SEQ ID NO: 9718 - RNA, 20 nt, Artificial Sequence
  Guide Sequence
gcuccccacucuccagccaa

SEQ ID NO: 9719 - RNA, 20 nt, Artificial Sequence
  Guide Sequence
gcucuuagaaugucauaaaa

SEQ ID NO: 9720 - RNA, 20 nt, Artificial Sequence
  Guide Sequence
ggaaagagcucagaggagac

SEQ ID NO: 9721 - RNA, 20 nt, Artificial Sequence
  Guide Sequence
ggaaguaugguuugugccag

SEQ ID NO: 9722 - RNA, 20 nt, Artificial Sequence
  Guide Sequence
ggagacagggaaguaugguu

SEQ ID NO: 9723 - RNA, 20 nt, Artificial Sequence
  Guide Sequence
ggaguaccaaguuaucgaau

SEQ ID NO: 9724 - RNA, 20 nt, Artificial Sequence
  Guide Sequence
ggcgggaaagagcucagagg

SEQ ID NO: 9725 - RNA, 20 nt, Artificial Sequence
  Guide Sequence
ggcucaaagccacagguccu

SEQ ID NO: 9726 - RNA, 20 nt, Artificial Sequence
  Guide Sequence
gggaaagagcucagaggaga

SEQ ID NO: 9727 - RNA, 20 nt, Artificial Sequence
  Guide Sequence
gggaaguaugguuugugcca

SEQ ID NO: 9728 - RNA, 20 nt, Artificial Sequence
  Guide Sequence
gggcgggaaagagcucagag

SEQ ID NO: 9729 - RNA, 20 nt, Artificial Sequence
  Guide Sequence
ggggcgggaaagagcucaga

SEQ ID NO: 9730 - RNA, 20 nt, Artificial Sequence
  Guide Sequence
ggggucacccagcuccccac

SEQ ID NO: 9731 - RNA, 20 nt, Artificial Sequence
  Guide Sequence
gggucacccagcuccccacu

SEQ ID NO: 9732 - RNA, 20 nt, Artificial Sequence
  Guide Sequence
ggguuucucucccucuuggg

SEQ ID NO: 9733 - RNA, 20 nt, Artificial Sequence
  Guide Sequence
ggucacccagcuccccacuc

SEQ ID NO: 9734 - RNA, 20 nt, Artificial Sequence
  Guide Sequence
gguccuccucucacaaagcu

SEQ ID NO: 9735 - RNA, 20 nt, Artificial Sequence
  Guide Sequence
ggugacacaaccaaggguuu

SEQ ID NO: 9736 - RNA, 20 nt, Artificial Sequence
  Guide Sequence
gguuuccccugaggcucaaa

SEQ ID NO: 9737 - RNA, 20 nt, Artificial Sequence
  Guide Sequence
gguuucucucccucuugggg

SEQ ID NO: 9738 - RNA, 20 nt, Artificial Sequence
  Guide Sequence
gguuugugccaggggucacc

SEQ ID NO: 9739 - RNA, 20 nt, Artificial Sequence
  Guide Sequence
guaccaaguuaucgaauguc

SEQ ID NO: 9740 - RNA, 20 nt, Artificial Sequence
  Guide Sequence
guaugguuugugccaggggu

SEQ ID NO: 9741 - RNA, 20 nt, Artificial Sequence
  Guide Sequence
gucacaucacacaaagcaag

SEQ ID NO: 9742 - RNA, 20 nt, Artificial Sequence
  Guide Sequence
gucacccagcuccccacucu

SEQ ID NO: 9743 - RNA, 20 nt, Artificial Sequence
  Guide Sequence
gucauaaaaacuuggaguac

SEQ ID NO: 9744 - RNA, 20 nt, Artificial Sequence
  Guide Sequence
guccuccucucacaaagcuc

SEQ ID NO: 9745 - RNA, 20 nt, Artificial Sequence
  Guide Sequence
gucucugguuuccccugagg

SEQ ID NO: 9746 - RNA, 20 nt, Artificial Sequence
  Guide Sequence
gugacacaaccaaggguuuc

SEQ ID NO: 9747 - RNA, 20 nt, Artificial Sequence
  Guide Sequence
gugccaggggucacccagcu

SEQ ID NO: 9748 - RNA, 20 nt, Artificial Sequence
  Guide Sequence
gugggaaaagcacgauucag

SEQ ID NO: 9749 - RNA, 20 nt, Artificial Sequence
  Guide Sequence
guggugacacaaccaagggu

SEQ ID NO: 9750 - RNA, 20 nt, Artificial Sequence
  Guide Sequence
guuaucgaaugucacaucac

SEQ ID NO: 9751 - RNA, 20 nt, Artificial Sequence
  Guide Sequence
guuuccccugaggcucaaag

SEQ ID NO: 9752 - RNA, 20 nt, Artificial Sequence
  Guide Sequence
guuucucucccucuuggggc

SEQ ID NO: 9753 - RNA, 20 nt, Artificial Sequence
  Guide Sequence
guuugugccaggggucaccc

SEQ ID NO: 9754 - RNA, 20 nt, Artificial Sequence
  Guide Sequence
uaaaaacuuggaguaccaag

SEQ ID NO: 9755 - RNA, 20 nt, Artificial Sequence
  Guide Sequence
uaagaccaaaacagugggaa

SEQ ID NO: 9756 - RNA, 20 nt, Artificial Sequence
  Guide Sequence
uaccaaguuaucgaauguca

SEQ ID NO: 9757 - RNA, 20 nt, Artificial Sequence
  Guide Sequence
uaucgaaugucacaucacac

SEQ ID NO: 9758 - RNA, 20 nt, Artificial Sequence
  Guide Sequence
uaugguuugugccagggguc

SEQ ID NO: 9759 - RNA, 20 nt, Artificial Sequence
  Guide Sequence
ucaaagccacagguccuccu

SEQ ID NO: 9760 - RNA, 20 nt, Artificial Sequence
  Guide Sequence
ucacaaagcucuuagaaugu

SEQ ID NO: 9761 - RNA, 20 nt, Artificial Sequence
  Guide Sequence
ucacacaaagcaagugguga

SEQ ID NO: 9762 - RNA, 20 nt, Artificial Sequence
  Guide Sequence
ucacaucacacaaagcaagu

SEQ ID NO: 9763 - RNA, 20 nt, Artificial Sequence
  Guide Sequence
ucacccagcuccccacucuc

SEQ ID NO: 9764 - RNA, 20 nt, Artificial Sequence
  Guide Sequence
ucagaggagacagggaagua

SEQ ID NO: 9765 - RNA, 20 nt, Artificial Sequence
  Guide Sequence
ucauaaaaacuuggaguacc

SEQ ID NO: 9766 - RNA, 20 nt, Artificial Sequence
  Guide Sequence
ucaucugucucugguuuccc

SEQ ID NO: 9767 - RNA, 20 nt, Artificial Sequence
  Guide Sequence
uccccacucuccagccaaag

SEQ ID NO: 9768 - RNA, 20 nt, Artificial Sequence
  Guide Sequence
uccccugaggcucaaagcca

SEQ ID NO: 9769 - RNA, 20 nt, Artificial Sequence
  Guide Sequence
ucccucuuggggcgggaaag

SEQ ID NO: 9770 - RNA, 20 nt, Artificial Sequence
  Guide Sequence
uccuccucucacaaagcucu

SEQ ID NO: 9771 - RNA, 20 nt, Artificial Sequence
  Guide Sequence
uccucucacaaagcucuuag

SEQ ID NO: 9772 - RNA, 20 nt, Artificial Sequence
  Guide Sequence
ucgaaugucacaucacacaa

SEQ ID NO: 9773 - RNA, 20 nt, Artificial Sequence
  Guide Sequence
ucucacaaagcucuuagaau

SEQ ID NO: 9774 - RNA, 20 nt, Artificial Sequence
  Guide Sequence
ucucccucuuggggcgggaa

SEQ ID NO: 9775 - RNA, 20 nt, Artificial Sequence
  Guide Sequence
ucucucccucuuggggcggg

SEQ ID NO: 9776 - RNA, 20 nt, Artificial Sequence
  Guide Sequence
ucucugguuuccccugaggc

SEQ ID NO: 9777 - RNA, 20 nt, Artificial Sequence
  Guide Sequence
ucugguuuccccugaggcuc

SEQ ID NO: 9778 - RNA, 20 nt, Artificial Sequence
  Guide Sequence
ucugucucugguuuccccug

SEQ ID NO: 9779 - RNA, 20 nt, Artificial Sequence
  Guide Sequence
ucuuggggcgggaaagagcu

SEQ ID NO: 9780 - RNA, 20 nt, Artificial Sequence
  Guide Sequence
ugacacaaccaaggguuucu

SEQ ID NO: 9781 - RNA, 20 nt, Artificial Sequence
  Guide Sequence
ugaggcucaaagccacaggu

SEQ ID NO: 9782 - RNA, 20 nt, Artificial Sequence
  Guide Sequence
ugccaggggucacccagcuc

SEQ ID NO: 9783 - RNA, 20 nt, Artificial Sequence
  Guide Sequence
uggaguaccaaguuaucgaa

SEQ ID NO: 9784 - RNA, 20 nt, Artificial Sequence
  Guide Sequence
ugggaaaagcacgauucagu

SEQ ID NO: 9785 - RNA, 20 nt, Artificial Sequence
  Guide Sequence
uggggcgggaaagagcucag

SEQ ID NO: 9786 - RNA, 20 nt, Artificial Sequence
  Guide Sequence
uggugacacaaccaaggguu

SEQ ID NO: 9787 - RNA, 20 nt, Artificial Sequence
  Guide Sequence
ugguuuccccugaggcucaa

SEQ ID NO: 9788 - RNA, 20 nt, Artificial Sequence
  Guide Sequence
ugguuugugccaggggucac

SEQ ID NO: 9789 - RNA, 20 nt, Artificial Sequence
  Guide Sequence
ugucacaucacacaaagcaa

SEQ ID NO: 9790 - RNA, 20 nt, Artificial Sequence
  Guide Sequence
ugucauaaaaacuuggagua

SEQ ID NO: 9791 - RNA, 20 nt, Artificial Sequence
  Guide Sequence
ugucucugguuuccccugag

SEQ ID NO: 9792 - RNA, 20 nt, Artificial Sequence
  Guide Sequence
ugugccaggggucacccagc

SEQ ID NO: 9793 - RNA, 20 nt, Artificial Sequence
  Guide Sequence
uuaucgaaugucacaucaca

SEQ ID NO: 9794 - RNA, 20 nt, Artificial Sequence
  Guide Sequence
uucaucugucucugguuucc

SEQ ID NO: 9795 - RNA, 20 nt, Artificial Sequence
  Guide Sequence
uuccccugaggcucaaagcc

SEQ ID NO: 9796 - RNA, 20 nt, Artificial Sequence
  Guide Sequence
uucucucccucuuggggcgg

SEQ ID NO: 9797 - RNA, 20 nt, Artificial Sequence
  Guide Sequence
uuggaguaccaaguuaucga

SEQ ID NO: 9798 - RNA, 20 nt, Artificial Sequence
  Guide Sequence
uuggggcgggaaagagcuca

SEQ ID NO: 9799 - RNA, 20 nt, Artificial Sequence
  Guide Sequence
uugugccaggggucacccag

SEQ ID NO: 9800 - RNA, 20 nt, Artificial Sequence
  Guide Sequence
uuuccccugaggcucaaagc

SEQ ID NO: 9801 - RNA, 20 nt, Artificial Sequence
  Guide Sequence
uuucucucccucuuggggcg

SEQ ID NO: 9802 - RNA, 20 nt, Artificial Sequence
  Guide Sequence
uuugugccaggggucaccca

SEQ ID NO: 9803 - RNA, 21 nt, Artificial Sequence
  Guide Sequence
aaaaacuuggaguaccaaguu

SEQ ID NO: 9804 - RNA, 21 nt, Artificial Sequence
  Guide Sequence
aaaacagugggaaaagcacga

SEQ ID NO: 9805 - RNA, 21 nt, Artificial Sequence
  Guide Sequence
aaaacuuggaguaccaaguua

SEQ ID NO: 9806 - RNA, 21 nt, Artificial Sequence
  Guide Sequence
aaacagugggaaaagcacgau

SEQ ID NO: 9807 - RNA, 21 nt, Artificial Sequence
  Guide Sequence
aaacuuggaguaccaaguuau

SEQ ID NO: 9808 - RNA, 21 nt, Artificial Sequence
  Guide Sequence
aaagagcucagaggagacagg

SEQ ID NO: 9809 - RNA, 21 nt, Artificial Sequence
  Guide Sequence
aaagcaaguggugacacaacc

SEQ ID NO: 9810 - RNA, 21 nt, Artificial Sequence
  Guide Sequence
aaagccacagguccuccucuc

SEQ ID NO: 9811 - RNA, 21 nt, Artificial Sequence
  Guide Sequence
aacagugggaaaagcacgauu

SEQ ID NO: 9812 - RNA, 21 nt, Artificial Sequence
  Guide Sequence
aaccaaggguuucucucccuc

SEQ ID NO: 9813 - RNA, 21 nt, Artificial Sequence
  Guide Sequence
aacuuggaguaccaaguuauc

SEQ ID NO: 9814 - RNA, 21 nt, Artificial Sequence
  Guide Sequence
aagaccaaaacagugggaaaa

SEQ ID NO: 9815 - RNA, 21 nt, Artificial Sequence
  Guide Sequence
aagagcucagaggagacaggg

SEQ ID NO: 9816 - RNA, 21 nt, Artificial Sequence
  Guide Sequence
aagcaaguggugacacaacca

SEQ ID NO: 9817 - RNA, 21 nt, Artificial Sequence
  Guide Sequence
aagccacagguccuccucuca

SEQ ID NO: 9818 - RNA, 21 nt, Artificial Sequence
  Guide Sequence
aaggguuucucucccucuugg

SEQ ID NO: 9819 - RNA, 21 nt, Artificial Sequence
  Guide Sequence
aaguaugguuugugccagggg

SEQ ID NO: 9820 - RNA, 21 nt, Artificial Sequence
  Guide Sequence
aaguggugacacaaccaaggg

SEQ ID NO: 9821 - RNA, 21 nt, Artificial Sequence
  Guide Sequence
aaguuaucgaaugucacauca

SEQ ID NO: 9822 - RNA, 21 nt, Artificial Sequence
  Guide Sequence
aaugucacaucacacaaagca

SEQ ID NO: 9823 - RNA, 21 nt, Artificial Sequence
  Guide Sequence
acaaagcaaguggugacacaa

SEQ ID NO: 9824 - RNA, 21 nt, Artificial Sequence
  Guide Sequence
acaaagcucuuagaaugucau

SEQ ID NO: 9825 - RNA, 21 nt, Artificial Sequence
  Guide Sequence
acaaccaaggguuucucuccc

SEQ ID NO: 9826 - RNA, 21 nt, Artificial Sequence
  Guide Sequence
acacaaagcaaguggugacac

SEQ ID NO: 9827 - RNA, 21 nt, Artificial Sequence
  Guide Sequence
acacaaccaaggguuucucuc

SEQ ID NO: 9828 - RNA, 21 nt, Artificial Sequence
  Guide Sequence
acagggaaguaugguuugugc

SEQ ID NO: 9829 - RNA, 21 nt, Artificial Sequence
  Guide Sequence
acagguccuccucucacaaag

SEQ ID NO: 9830 - RNA, 21 nt, Artificial Sequence
  Guide Sequence
acagugggaaaagcacgauuc

SEQ ID NO: 9831 - RNA, 21 nt, Artificial Sequence
  Guide Sequence
acaucacacaaagcaaguggu

SEQ ID NO: 9832 - RNA, 21 nt, Artificial Sequence
  Guide Sequence
acauucaucugucucugguuu

SEQ ID NO: 9833 - RNA, 21 nt, Artificial Sequence
  Guide Sequence
accaaaacagugggaaaagca

SEQ ID NO: 9834 - RNA, 21 nt, Artificial Sequence
  Guide Sequence
accaaggguuucucucccucu

SEQ ID NO: 9835 - RNA, 21 nt, Artificial Sequence
  Guide Sequence
accaaguuaucgaaugucaca

SEQ ID NO: 9836 - RNA, 21 nt, Artificial Sequence
  Guide Sequence
acccagcuccccacucuccag

SEQ ID NO: 9837 - RNA, 21 nt, Artificial Sequence
  Guide Sequence
acucuccagccaaagaccuaa

SEQ ID NO: 9838 - RNA, 21 nt, Artificial Sequence
  Guide Sequence
acuuggaguaccaaguuaucg

SEQ ID NO: 9839 - RNA, 21 nt, Artificial Sequence
  Guide Sequence
agacagggaaguaugguuugu

SEQ ID NO: 9840 - RNA, 21 nt, Artificial Sequence
  Guide Sequence
agaccaaaacagugggaaaag

SEQ ID NO: 9841 - RNA, 21 nt, Artificial Sequence
  Guide Sequence
agagcucagaggagacaggga

SEQ ID NO: 9842 - RNA, 21 nt, Artificial Sequence
  Guide Sequence
agaggagacagggaaguaugg

SEQ ID NO: 9843 - RNA, 21 nt, Artificial Sequence
  Guide Sequence
agcaaguggugacacaaccaa

SEQ ID NO: 9844 - RNA, 21 nt, Artificial Sequence
  Guide Sequence
agccacagguccuccucucac

SEQ ID NO: 9845 - RNA, 21 nt, Artificial Sequence
  Guide Sequence
agcucagaggagacagggaag

SEQ ID NO: 9846 - RNA, 21 nt, Artificial Sequence
  Guide Sequence
agcuccccacucuccagccaa

SEQ ID NO: 9847 - RNA, 21 nt, Artificial Sequence
  Guide Sequence
aggagacagggaaguaugguu

SEQ ID NO: 9848 - RNA, 21 nt, Artificial Sequence
  Guide Sequence
aggcucaaagccacagguccu

SEQ ID NO: 9849 - RNA, 21 nt, Artificial Sequence
  Guide Sequence
agggaaguaugguuugugcca

SEQ ID NO: 9850 - RNA, 21 nt, Artificial Sequence
  Guide Sequence
aggggucacccagcuccccac

SEQ ID NO: 9851 - RNA, 21 nt, Artificial Sequence
  Guide Sequence
aggguuucucucccucuuggg

SEQ ID NO: 9852 - RNA, 21 nt, Artificial Sequence
  Guide Sequence
agguccuccucucacaaagcu

SEQ ID NO: 9853 - RNA, 21 nt, Artificial Sequence
  Guide Sequence
aguaccaaguuaucgaauguc

SEQ ID NO: 9854 - RNA, 21 nt, Artificial Sequence
  Guide Sequence
aguaugguuugugccaggggu

SEQ ID NO: 9855 - RNA, 21 nt, Artificial Sequence
  Guide Sequence
agugggaaaagcacgauucag

SEQ ID NO: 9856 - RNA, 21 nt, Artificial Sequence
  Guide Sequence
aguggugacacaaccaagggu

SEQ ID NO: 9857 - RNA, 21 nt, Artificial Sequence
  Guide Sequence
aguuaucgaaugucacaucac

SEQ ID NO: 9858 - RNA, 21 nt, Artificial Sequence
  Guide Sequence
auaaaaacuuggaguaccaag

SEQ ID NO: 9859 - RNA, 21 nt, Artificial Sequence
  Guide Sequence
aucacacaaagcaagugguga

SEQ ID NO: 9860 - RNA, 21 nt, Artificial Sequence
  Guide Sequence
aucgaaugucacaucacacaa

SEQ ID NO: 9861 - RNA, 21 nt, Artificial Sequence
  Guide Sequence
aucugucucugguuuccccug

SEQ ID NO: 9862 - RNA, 21 nt, Artificial Sequence
  Guide Sequence
augguuugugccaggggucac

SEQ ID NO: 9863 - RNA, 21 nt, Artificial Sequence
  Guide Sequence
augucacaucacacaaagcaa

SEQ ID NO: 9864 - RNA, 21 nt, Artificial Sequence
  Guide Sequence
auucaucugucucugguuucc

SEQ ID NO: 9865 - RNA, 21 nt, Artificial Sequence
  Guide Sequence
caaaacagugggaaaagcacg

SEQ ID NO: 9866 - RNA, 21 nt, Artificial Sequence
  Guide Sequence
caaagcaaguggugacacaac

SEQ ID NO: 9867 - RNA, 21 nt, Artificial Sequence
  Guide Sequence
caaagccacagguccuccucu

SEQ ID NO: 9868 - RNA, 21 nt, Artificial Sequence
  Guide Sequence
caaagcucuuagaaugucaua

SEQ ID NO: 9869 - RNA, 21 nt, Artificial Sequence
  Guide Sequence
caaccaaggguuucucucccu

SEQ ID NO: 9870 - RNA, 21 nt, Artificial Sequence
  Guide Sequence
caaggguuucucucccucuug

SEQ ID NO: 9871 - RNA, 21 nt, Artificial Sequence
  Guide Sequence
caaguggugacacaaccaagg

SEQ ID NO: 9872 - RNA, 21 nt, Artificial Sequence
  Guide Sequence
caaguuaucgaaugucacauc

SEQ ID NO: 9873 - RNA, 21 nt, Artificial Sequence
  Guide Sequence
cacaaagcaaguggugacaca

SEQ ID NO: 9874 - RNA, 21 nt, Artificial Sequence
  Guide Sequence
cacaaagcucuuagaauguca

SEQ ID NO: 9875 - RNA, 21 nt, Artificial Sequence
  Guide Sequence
cacaaccaaggguuucucucc

SEQ ID NO: 9876 - RNA, 21 nt, Artificial Sequence
  Guide Sequence
cacacaaagcaaguggugaca

SEQ ID NO: 9877 - RNA, 21 nt, Artificial Sequence
  Guide Sequence
cacagguccuccucucacaaa

SEQ ID NO: 9878 - RNA, 21 nt, Artificial Sequence
  Guide Sequence
cacaucacacaaagcaagugg

SEQ ID NO: 9879 - RNA, 21 nt, Artificial Sequence
  Guide Sequence
cacccagcuccccacucucca

SEQ ID NO: 9880 - RNA, 21 nt, Artificial Sequence
  Guide Sequence
cacucuccagccaaagaccua

SEQ ID NO: 9881 - RNA, 21 nt, Artificial Sequence
  Guide Sequence
cagaggagacagggaaguaug

SEQ ID NO: 9882 - RNA, 21 nt, Artificial Sequence
  Guide Sequence
cagcuccccacucuccagcca

SEQ ID NO: 9883 - RNA, 21 nt, Artificial Sequence
  Guide Sequence
cagggaaguaugguuugugcc

SEQ ID NO: 9884 - RNA, 21 nt, Artificial Sequence
  Guide Sequence
caggggucacccagcucccca

SEQ ID NO: 9885 - RNA, 21 nt, Artificial Sequence
  Guide Sequence
cagguccuccucucacaaagc

SEQ ID NO: 9886 - RNA, 21 nt, Artificial Sequence
  Guide Sequence
cagugggaaaagcacgauuca

SEQ ID NO: 9887 - RNA, 21 nt, Artificial Sequence
  Guide Sequence
cauaaaaacuuggaguaccaa

SEQ ID NO: 9888 - RNA, 21 nt, Artificial Sequence
  Guide Sequence
caucacacaaagcaaguggug

SEQ ID NO: 9889 - RNA, 21 nt, Artificial Sequence
  Guide Sequence
caucugucucugguuuccccu

SEQ ID NO: 9890 - RNA, 21 nt, Artificial Sequence
  Guide Sequence
cauucaucugucucugguuuc

SEQ ID NO: 9891 - RNA, 21 nt, Artificial Sequence
  Guide Sequence
ccaaaacagugggaaaagcac

SEQ ID NO: 9892 - RNA, 21 nt, Artificial Sequence
  Guide Sequence
ccaaggguuucucucccucuu

SEQ ID NO: 9893 - RNA, 21 nt, Artificial Sequence
  Guide Sequence
ccaaguuaucgaaugucacau

SEQ ID NO: 9894 - RNA, 21 nt, Artificial Sequence
  Guide Sequence
ccacagguccuccucucacaa

SEQ ID NO: 9895 - RNA, 21 nt, Artificial Sequence
  Guide Sequence
ccacucuccagccaaagaccu

SEQ ID NO: 9896 - RNA, 21 nt, Artificial Sequence
  Guide Sequence
ccagccaaagaccuaaguucc

SEQ ID NO: 9897 - RNA, 21 nt, Artificial Sequence
  Guide Sequence
ccagcuccccacucuccagcc

SEQ ID NO: 9898 - RNA, 21 nt, Artificial Sequence
  Guide Sequence
ccaggggucacccagcucccc

SEQ ID NO: 9899 - RNA, 21 nt, Artificial Sequence
  Guide Sequence
cccacucuccagccaaagacc

SEQ ID NO: 9900 - RNA, 21 nt, Artificial Sequence
  Guide Sequence
cccagcuccccacucuccagc

SEQ ID NO: 9901 - RNA, 21 nt, Artificial Sequence
  Guide Sequence
ccccacucuccagccaaagac

SEQ ID NO: 9902 - RNA, 21 nt, Artificial Sequence
  Guide Sequence
ccccugaggcucaaagccaca

SEQ ID NO: 9903 - RNA, 21 nt, Artificial Sequence
  Guide Sequence
cccucuuggggcgggaaagag

SEQ ID NO: 9904 - RNA, 21 nt, Artificial Sequence
  Guide Sequence
cccugaggcucaaagccacag

SEQ ID NO: 9905 - RNA, 21 nt, Artificial Sequence
  Guide Sequence
ccuccucucacaaagcucuua

SEQ ID NO: 9906 - RNA, 21 nt, Artificial Sequence
  Guide Sequence
ccucucacaaagcucuuagaa

SEQ ID NO: 9907 - RNA, 21 nt, Artificial Sequence
  Guide Sequence
ccucuuggggcgggaaagagc

SEQ ID NO: 9908 - RNA, 21 nt, Artificial Sequence
  Guide Sequence
ccugaggcucaaagccacagg

SEQ ID NO: 9909 - RNA, 21 nt, Artificial Sequence
  Guide Sequence
cgaaugucacaucacacaaag

SEQ ID NO: 9910 - RNA, 21 nt, Artificial Sequence
  Guide Sequence
cgggaaagagcucagaggaga

SEQ ID NO: 9911 - RNA, 21 nt, Artificial Sequence
  Guide Sequence
cuaagaccaaaacagugggaa

SEQ ID NO: 9912 - RNA, 21 nt, Artificial Sequence
  Guide Sequence
cucaaagccacagguccuccu

SEQ ID NO: 9913 - RNA, 21 nt, Artificial Sequence
  Guide Sequence
cucacaaagcucuuagaaugu

SEQ ID NO: 9914 - RNA, 21 nt, Artificial Sequence
  Guide Sequence
cucagaggagacagggaagua

SEQ ID NO: 9915 - RNA, 21 nt, Artificial Sequence
  Guide Sequence
cuccccacucuccagccaaag

SEQ ID NO: 9916 - RNA, 21 nt, Artificial Sequence
  Guide Sequence
cucccucuuggggcgggaaag

SEQ ID NO: 9917 - RNA, 21 nt, Artificial Sequence
  Guide Sequence
cuccucucacaaagcucuuag

SEQ ID NO: 9918 - RNA, 21 nt, Artificial Sequence
  Guide Sequence
cucucacaaagcucuuagaau

SEQ ID NO: 9919 - RNA, 21 nt, Artificial Sequence
  Guide Sequence
cucucccucuuggggcgggaa

SEQ ID NO: 9920 - RNA, 21 nt, Artificial Sequence
  Guide Sequence
cucugguuuccccugaggcuc

SEQ ID NO: 9921 - RNA, 21 nt, Artificial Sequence
  Guide Sequence
cucuuggggcgggaaagagcu

SEQ ID NO: 9922 - RNA, 21 nt, Artificial Sequence
  Guide Sequence
cugaggcucaaagccacaggu

SEQ ID NO: 9923 - RNA, 21 nt, Artificial Sequence
  Guide Sequence
cugguuuccccugaggcucaa

SEQ ID NO: 9924 - RNA, 21 nt, Artificial Sequence
  Guide Sequence
cugucucugguuuccccugag

SEQ ID NO: 9925 - RNA, 21 nt, Artificial Sequence
  Guide Sequence
cuuggaguaccaaguuaucga

SEQ ID NO: 9926 - RNA, 21 nt, Artificial Sequence
  Guide Sequence
cuuggggcgggaaagagcuca

SEQ ID NO: 9927 - RNA, 21 nt, Artificial Sequence
  Guide Sequence
gaaagagcucagaggagacag

SEQ ID NO: 9928 - RNA, 21 nt, Artificial Sequence
  Guide Sequence
gaaguaugguuugugccaggg

SEQ ID NO: 9929 - RNA, 21 nt, Artificial Sequence
  Guide Sequence
gaaugucacaucacacaaagc

SEQ ID NO: 9930 - RNA, 21 nt, Artificial Sequence
  Guide Sequence
gaaugucauaaaaacuuggag

SEQ ID NO: 9931 - RNA, 21 nt, Artificial Sequence
  Guide Sequence
gacacaaccaaggguuucucu

SEQ ID NO: 9932 - RNA, 21 nt, Artificial Sequence
  Guide Sequence
gacagggaaguaugguuugug

SEQ ID NO: 9933 - RNA, 21 nt, Artificial Sequence
  Guide Sequence
gaccaaaacagugggaaaagc

SEQ ID NO: 9934 - RNA, 21 nt, Artificial Sequence
  Guide Sequence
gagacagggaaguaugguuug

SEQ ID NO: 9935 - RNA, 21 nt, Artificial Sequence
  Guide Sequence
gagcucagaggagacagggaa

SEQ ID NO: 9936 - RNA, 21 nt, Artificial Sequence
  Guide Sequence
gaggagacagggaaguauggu

SEQ ID NO: 9937 - RNA, 21 nt, Artificial Sequence
  Guide Sequence
gaggcucaaagccacaggucc

SEQ ID NO: 9938 - RNA, 21 nt, Artificial Sequence
  Guide Sequence
gaguaccaaguuaucgaaugu

SEQ ID NO: 9939 - RNA, 21 nt, Artificial Sequence
  Guide Sequence
gcaaguggugacacaaccaag

SEQ ID NO: 9940 - RNA, 21 nt, Artificial Sequence
  Guide Sequence
gccacagguccuccucucaca

SEQ ID NO: 9941 - RNA, 21 nt, Artificial Sequence
  Guide Sequence
gccaggggucacccagcuccc

SEQ ID NO: 9942 - RNA, 21 nt, Artificial Sequence
  Guide Sequence
gcgggaaagagcucagaggag

SEQ ID NO: 9943 - RNA, 21 nt, Artificial Sequence
  Guide Sequence
gcucaaagccacagguccucc

SEQ ID NO: 9944 - RNA, 21 nt, Artificial Sequence
  Guide Sequence
gcucagaggagacagggaagu

SEQ ID NO: 9945 - RNA, 21 nt, Artificial Sequence
  Guide Sequence
gcuccccacucuccagccaaa

SEQ ID NO: 9946 - RNA, 21 nt, Artificial Sequence
  Guide Sequence
ggaaagagcucagaggagaca

SEQ ID NO: 9947 - RNA, 21 nt, Artificial Sequence
  Guide Sequence
ggaaguaugguuugugccagg

SEQ ID NO: 9948 - RNA, 21 nt, Artificial Sequence
  Guide Sequence
ggagacagggaaguaugguuu

SEQ ID NO: 9949 - RNA, 21 nt, Artificial Sequence
  Guide Sequence
ggaguaccaaguuaucgaaug

SEQ ID NO: 9950 - RNA, 21 nt, Artificial Sequence
  Guide Sequence
ggcgggaaagagcucagagga

SEQ ID NO: 9951 - RNA, 21 nt, Artificial Sequence
  Guide Sequence
ggcucaaagccacagguccuc

SEQ ID NO: 9952 - RNA, 21 nt, Artificial Sequence
  Guide Sequence
gggaaagagcucagaggagac

SEQ ID NO: 9953 - RNA, 21 nt, Artificial Sequence
  Guide Sequence
gggaaguaugguuugugccag

SEQ ID NO: 9954 - RNA, 21 nt, Artificial Sequence
  Guide Sequence
gggcgggaaagagcucagagg

SEQ ID NO: 9955 - RNA, 21 nt, Artificial Sequence
  Guide Sequence
ggggcgggaaagagcucagag

SEQ ID NO: 9956 - RNA, 21 nt, Artificial Sequence
  Guide Sequence
ggggucacccagcuccccacu

SEQ ID NO: 9957 - RNA, 21 nt, Artificial Sequence
  Guide Sequence
gggucacccagcuccccacuc

SEQ ID NO: 9958 - RNA, 21 nt, Artificial Sequence
  Guide Sequence
ggguuucucucccucuugggg

SEQ ID NO: 9959 - RNA, 21 nt, Artificial Sequence
  Guide Sequence
ggucacccagcuccccacucu

SEQ ID NO: 9960 - RNA, 21 nt, Artificial Sequence
  Guide Sequence
gguccuccucucacaaagcuc

SEQ ID NO: 9961 - RNA, 21 nt, Artificial Sequence
  Guide Sequence
ggugacacaaccaaggguuuc

SEQ ID NO: 9962 - RNA, 21 nt, Artificial Sequence
  Guide Sequence
gguuuccccugaggcucaaag

SEQ ID NO: 9963 - RNA, 21 nt, Artificial Sequence
  Guide Sequence
gguuucucucccucuuggggc

SEQ ID NO: 9964 - RNA, 21 nt, Artificial Sequence
  Guide Sequence
gguuugugccaggggucaccc

SEQ ID NO: 9965 - RNA, 21 nt, Artificial Sequence
  Guide Sequence
guaccaaguuaucgaauguca

SEQ ID NO: 9966 - RNA, 21 nt, Artificial Sequence
  Guide Sequence
guaugguuugugccagggguc

SEQ ID NO: 9967 - RNA, 21 nt, Artificial Sequence
  Guide Sequence
gucacaucacacaaagcaagu

SEQ ID NO: 9968 - RNA, 21 nt, Artificial Sequence
  Guide Sequence
gucacccagcuccccacucuc

SEQ ID NO: 9969 - RNA, 21 nt, Artificial Sequence
  Guide Sequence
gucauaaaaacuuggaguacc

SEQ ID NO: 9970 - RNA, 21 nt, Artificial Sequence
  Guide Sequence
guccuccucucacaaagcucu

SEQ ID NO: 9971 - RNA, 21 nt, Artificial Sequence
  Guide Sequence
gucucugguuuccccugaggc

SEQ ID NO: 9972 - RNA, 21 nt, Artificial Sequence
  Guide Sequence
gugacacaaccaaggguuucu

SEQ ID NO: 9973 - RNA, 21 nt, Artificial Sequence
  Guide Sequence
gugccaggggucacccagcuc

SEQ ID NO: 9974 - RNA, 21 nt, Artificial Sequence
  Guide Sequence
gugggaaaagcacgauucagu

SEQ ID NO: 9975 - RNA, 21 nt, Artificial Sequence
  Guide Sequence
guggugacacaaccaaggguu

SEQ ID NO: 9976 - RNA, 21 nt, Artificial Sequence
  Guide Sequence
guuaucgaaugucacaucaca

SEQ ID NO: 9977 - RNA, 21 nt, Artificial Sequence
  Guide Sequence
guuuccccugaggcucaaagc

SEQ ID NO: 9978 - RNA, 21 nt, Artificial Sequence
  Guide Sequence
guuucucucccucuuggggcg

SEQ ID NO: 9979 - RNA, 21 nt, Artificial Sequence
  Guide Sequence
guuugugccaggggucaccca

SEQ ID NO: 9980 - RNA, 21 nt, Artificial Sequence
  Guide Sequence
uaaaaacuuggaguaccaagu

SEQ ID NO: 9981 - RNA, 21 nt, Artificial Sequence
  Guide Sequence
uaagaccaaaacagugggaaa

SEQ ID NO: 9982 - RNA, 21 nt, Artificial Sequence
  Guide Sequence
uaccaaguuaucgaaugucac

SEQ ID NO: 9983 - RNA, 21 nt, Artificial Sequence
  Guide Sequence
uaucgaaugucacaucacaca

SEQ ID NO: 9984 - RNA, 21 nt, Artificial Sequence
  Guide Sequence
uaugguuugugccagggguca

SEQ ID NO: 9985 - RNA, 21 nt, Artificial Sequence
  Guide Sequence
ucaaagccacagguccuccuc

SEQ ID NO: 9986 - RNA, 21 nt, Artificial Sequence
  Guide Sequence
ucacaaagcucuuagaauguc

SEQ ID NO: 9987 - RNA, 21 nt, Artificial Sequence
  Guide Sequence
ucacacaaagcaaguggugac

SEQ ID NO: 9988 - RNA, 21 nt, Artificial Sequence
  Guide Sequence
ucacaucacacaaagcaagug

SEQ ID NO: 9989 - RNA, 21 nt, Artificial Sequence
  Guide Sequence
ucacccagcuccccacucucc

SEQ ID NO: 9990 - RNA, 21 nt, Artificial Sequence
  Guide Sequence
ucagaggagacagggaaguau

SEQ ID NO: 9991 - RNA, 21 nt, Artificial Sequence
  Guide Sequence
ucauaaaaacuuggaguacca

SEQ ID NO: 9992 - RNA, 21 nt, Artificial Sequence
  Guide Sequence
ucaucugucucugguuucccc

SEQ ID NO: 9993 - RNA, 21 nt, Artificial Sequence
  Guide Sequence
uccccacucuccagccaaaga

SEQ ID NO: 9994 - RNA, 21 nt, Artificial Sequence
  Guide Sequence
uccccugaggcucaaagccac

SEQ ID NO: 9995 - RNA, 21 nt, Artificial Sequence
  Guide Sequence
ucccucuuggggcgggaaaga

SEQ ID NO: 9996 - RNA, 21 nt, Artificial Sequence
  Guide Sequence
uccuccucucacaaagcucuu

SEQ ID NO: 9997 - RNA, 21 nt, Artificial Sequence
  Guide Sequence
uccucucacaaagcucuuaga

SEQ ID NO: 9998 - RNA, 21 nt, Artificial Sequence
  Guide Sequence
ucgaaugucacaucacacaaa

SEQ ID NO: 9999 - RNA, 21 nt, Artificial Sequence
  Guide Sequence
ucucacaaagcucuuagaaug

SEQ ID NO: 10000 - RNA, 21 nt, Artificial Sequence
  Guide Sequence
ucucccucuuggggcgggaaa

SEQ ID NO: 10001 - RNA, 21 nt, Artificial Sequence
  Guide Sequence
ucucucccucuuggggcggga

SEQ ID NO: 10002 - RNA, 21 nt, Artificial Sequence
  Guide Sequence
ucucugguuuccccugaggcu

SEQ ID NO: 10003 - RNA, 21 nt, Artificial Sequence
  Guide Sequence
ucugguuuccccugaggcuca

SEQ ID NO: 10004 - RNA, 21 nt, Artificial Sequence
  Guide Sequence
ucugucucugguuuccccuga

SEQ ID NO: 10005 - RNA, 21 nt, Artificial Sequence
  Guide Sequence
ucuuggggcgggaaagagcuc

SEQ ID NO: 10006 - RNA, 21 nt, Artificial Sequence
  Guide Sequence
ugacacaaccaaggguuucuc

SEQ ID NO: 10007 - RNA, 21 nt, Artificial Sequence
  Guide Sequence
ugaggcucaaagccacagguc

SEQ ID NO: 10008 - RNA, 21 nt, Artificial Sequence
  Guide Sequence
ugccaggggucacccagcucc

SEQ ID NO: 10009 - RNA, 21 nt, Artificial Sequence
  Guide Sequence
uggaguaccaaguuaucgaau

SEQ ID NO: 10010 - RNA, 21 nt, Artificial Sequence
  Guide Sequence
ugggaaaagcacgauucaguc

SEQ ID NO: 10011 - RNA, 21 nt, Artificial Sequence
  Guide Sequence
uggggcgggaaagagcucaga

SEQ ID NO: 10012 - RNA, 21 nt, Artificial Sequence
  Guide Sequence
uggugacacaaccaaggguuu

SEQ ID NO: 10013 - RNA, 21 nt, Artificial Sequence
  Guide Sequence
ugguuuccccugaggcucaaa

SEQ ID NO: 10014 - RNA, 21 nt, Artificial Sequence
  Guide Sequence
ugguuugugccaggggucacc

SEQ ID NO: 10015 - RNA, 21 nt, Artificial Sequence
  Guide Sequence
ugucacaucacacaaagcaag

SEQ ID NO: 10016 - RNA, 21 nt, Artificial Sequence
  Guide Sequence
ugucauaaaaacuuggaguac

SEQ ID NO: 10017 - RNA, 21 nt, Artificial Sequence
  Guide Sequence
ugucucugguuuccccugagg

SEQ ID NO: 10018 - RNA, 21 nt, Artificial Sequence
  Guide Sequence
ugugccaggggucacccagcu

SEQ ID NO: 10019 - RNA, 21 nt, Artificial Sequence
  Guide Sequence
uuaucgaaugucacaucacac

SEQ ID NO: 10020 - RNA, 21 nt, Artificial Sequence
  Guide Sequence
uucaucugucucugguuuccc

SEQ ID NO: 10021 - RNA, 21 nt, Artificial Sequence
  Guide Sequence
uuccccugaggcucaaagcca

SEQ ID NO: 10022 - RNA, 21 nt, Artificial Sequence
  Guide Sequence
uucucucccucuuggggcggg

SEQ ID NO: 10023 - RNA, 21 nt, Artificial Sequence
  Guide Sequence
uuggaguaccaaguuaucgaa

SEQ ID NO: 10024 - RNA, 21 nt, Artificial Sequence
  Guide Sequence
uuggggcgggaaagagcucag

SEQ ID NO: 10025 - RNA, 21 nt, Artificial Sequence
  Guide Sequence
uugugccaggggucacccagc

SEQ ID NO: 10026 - RNA, 21 nt, Artificial Sequence
  Guide Sequence
uuuccccugaggcucaaagcc

SEQ ID NO: 10027 - RNA, 21 nt, Artificial Sequence
  Guide Sequence
uuucucucccucuuggggcgg

SEQ ID NO: 10028 - RNA, 21 nt, Artificial Sequence
  Guide Sequence
uuugugccaggggucacccag

SEQ ID NO: 10029 - RNA, 22 nt, Artificial Sequence
  Guide Sequence
aaaaacuuggaguaccaaguua

SEQ ID NO: 10030 - RNA, 22 nt, Artificial Sequence
  Guide Sequence
aaaacagugggaaaagcacgau

SEQ ID NO: 10031 - RNA, 22 nt, Artificial Sequence
  Guide Sequence
aaaacuuggaguaccaaguuau

SEQ ID NO: 10032 - RNA, 22 nt, Artificial Sequence
  Guide Sequence
aaacagugggaaaagcacgauu

SEQ ID NO: 10033 - RNA, 22 nt, Artificial Sequence
  Guide Sequence
aaacuuggaguaccaaguuauc

SEQ ID NO: 10034 - RNA, 22 nt, Artificial Sequence
  Guide Sequence
aaagagcucagaggagacaggg

SEQ ID NO: 10035 - RNA, 22 nt, Artificial Sequence
  Guide Sequence
aaagcaaguggugacacaacca

SEQ ID NO: 10036 - RNA, 22 nt, Artificial Sequence
  Guide Sequence
aaagccacagguccuccucuca

SEQ ID NO: 10037 - RNA, 22 nt, Artificial Sequence
  Guide Sequence
aacagugggaaaagcacgauuc

SEQ ID NO: 10038 - RNA, 22 nt, Artificial Sequence
  Guide Sequence
aaccaaggguuucucucccucu

SEQ ID NO: 10039 - RNA, 22 nt, Artificial Sequence
  Guide Sequence
aacuuggaguaccaaguuaucg

SEQ ID NO: 10040 - RNA, 22 nt, Artificial Sequence
  Guide Sequence
aagaccaaaacagugggaaaag

SEQ ID NO: 10041 - RNA, 22 nt, Artificial Sequence
  Guide Sequence
aagagcucagaggagacaggga

SEQ ID NO: 10042 - RNA, 22 nt, Artificial Sequence
  Guide Sequence
aagcaaguggugacacaaccaa

SEQ ID NO: 10043 - RNA, 22 nt, Artificial Sequence
  Guide Sequence
aagccacagguccuccucucac

SEQ ID NO: 10044 - RNA, 22 nt, Artificial Sequence
  Guide Sequence
aaggguuucucucccucuuggg

SEQ ID NO: 10045 - RNA, 22 nt, Artificial Sequence
  Guide Sequence
aaguaugguuugugccaggggu

SEQ ID NO: 10046 - RNA, 22 nt, Artificial Sequence
  Guide Sequence
aaguggugacacaaccaagggu

SEQ ID NO: 10047 - RNA, 22 nt, Artificial Sequence
  Guide Sequence
aaguuaucgaaugucacaucac

SEQ ID NO: 10048 - RNA, 22 nt, Artificial Sequence
  Guide Sequence
aaugucacaucacacaaagcaa

SEQ ID NO: 10049 - RNA, 22 nt, Artificial Sequence
  Guide Sequence
acaaagcaaguggugacacaac

SEQ ID NO: 10050 - RNA, 22 nt, Artificial Sequence
  Guide Sequence
acaaagcucuuagaaugucaua

SEQ ID NO: 10051 - RNA, 22 nt, Artificial Sequence
  Guide Sequence
acaaccaaggguuucucucccu

SEQ ID NO: 10052 - RNA, 22 nt, Artificial Sequence
  Guide Sequence
acacaaagcaaguggugacaca

SEQ ID NO: 10053 - RNA, 22 nt, Artificial Sequence
  Guide Sequence
acacaaccaaggguuucucucc

SEQ ID NO: 10054 - RNA, 22 nt, Artificial Sequence
  Guide Sequence
acagggaaguaugguuugugcc

SEQ ID NO: 10055 - RNA, 22 nt, Artificial Sequence
  Guide Sequence
acagguccuccucucacaaagc

SEQ ID NO: 10056 - RNA, 22 nt, Artificial Sequence
  Guide Sequence
acagugggaaaagcacgauuca

SEQ ID NO: 10057 - RNA, 22 nt, Artificial Sequence
  Guide Sequence
acaucacacaaagcaaguggug

SEQ ID NO: 10058 - RNA, 22 nt, Artificial Sequence
  Guide Sequence
acauucaucugucucugguuuc

SEQ ID NO: 10059 - RNA, 22 nt, Artificial Sequence
  Guide Sequence
accaaaacagugggaaaagcac

SEQ ID NO: 10060 - RNA, 22 nt, Artificial Sequence
  Guide Sequence
accaaggguuucucucccucuu

SEQ ID NO: 10061 - RNA, 22 nt, Artificial Sequence
  Guide Sequence
accaaguuaucgaaugucacau

SEQ ID NO: 10062 - RNA, 22 nt, Artificial Sequence
  Guide Sequence
acccagcuccccacucuccagc

SEQ ID NO: 10063 - RNA, 22 nt, Artificial Sequence
  Guide Sequence
acuuggaguaccaaguuaucga

SEQ ID NO: 10064 - RNA, 22 nt, Artificial Sequence
  Guide Sequence
agaaugucauaaaaacuuggag

SEQ ID NO: 10065 - RNA, 22 nt, Artificial Sequence
  Guide Sequence
agacagggaaguaugguuugug

SEQ ID NO: 10066 - RNA, 22 nt, Artificial Sequence
  Guide Sequence
agaccaaaacagugggaaaagc

SEQ ID NO: 10067 - RNA, 22 nt, Artificial Sequence
  Guide Sequence
agagcucagaggagacagggaa

SEQ ID NO: 10068 - RNA, 22 nt, Artificial Sequence
  Guide Sequence
agaggagacagggaaguauggu

SEQ ID NO: 10069 - RNA, 22 nt, Artificial Sequence
  Guide Sequence
agcaaguggugacacaaccaag

SEQ ID NO: 10070 - RNA, 22 nt, Artificial Sequence
  Guide Sequence
agccacagguccuccucucaca

SEQ ID NO: 10071 - RNA, 22 nt, Artificial Sequence
  Guide Sequence
agcucagaggagacagggaagu

SEQ ID NO: 10072 - RNA, 22 nt, Artificial Sequence
  Guide Sequence
agcuccccacucuccagccaaa

SEQ ID NO: 10073 - RNA, 22 nt, Artificial Sequence
  Guide Sequence
aggagacagggaaguaugguuu

SEQ ID NO: 10074 - RNA, 22 nt, Artificial Sequence
  Guide Sequence
aggcucaaagccacagguccuc

SEQ ID NO: 10075 - RNA, 22 nt, Artificial Sequence
  Guide Sequence
agggaaguaugguuugugccag

SEQ ID NO: 10076 - RNA, 22 nt, Artificial Sequence
  Guide Sequence
aggggucacccagcuccccacu

SEQ ID NO: 10077 - RNA, 22 nt, Artificial Sequence
  Guide Sequence
aggguuucucucccucuugggg

SEQ ID NO: 10078 - RNA, 22 nt, Artificial Sequence
  Guide Sequence
agguccuccucucacaaagcuc

SEQ ID NO: 10079 - RNA, 22 nt, Artificial Sequence
  Guide Sequence
aguaccaaguuaucgaauguca

SEQ ID NO: 10080 - RNA, 22 nt, Artificial Sequence
  Guide Sequence
aguaugguuugugccagggguc

SEQ ID NO: 10081 - RNA, 22 nt, Artificial Sequence
  Guide Sequence
agugggaaaagcacgauucagu

SEQ ID NO: 10082 - RNA, 22 nt, Artificial Sequence
  Guide Sequence
aguggugacacaaccaaggguu

SEQ ID NO: 10083 - RNA, 22 nt, Artificial Sequence
  Guide Sequence
aguuaucgaaugucacaucaca

SEQ ID NO: 10084 - RNA, 22 nt, Artificial Sequence
  Guide Sequence
auaaaaacuuggaguaccaagu

SEQ ID NO: 10085 - RNA, 22 nt, Artificial Sequence
  Guide Sequence
aucacacaaagcaaguggugac

SEQ ID NO: 10086 - RNA, 22 nt, Artificial Sequence
  Guide Sequence
aucgaaugucacaucacacaaa

SEQ ID NO: 10087 - RNA, 22 nt, Artificial Sequence
  Guide Sequence
aucugucucugguuuccccuga

SEQ ID NO: 10088 - RNA, 22 nt, Artificial Sequence
  Guide Sequence
augguuugugccaggggucacc

SEQ ID NO: 10089 - RNA, 22 nt, Artificial Sequence
  Guide Sequence
augucacaucacacaaagcaag

SEQ ID NO: 10090 - RNA, 22 nt, Artificial Sequence
  Guide Sequence
augucauaaaaacuuggaguac

SEQ ID NO: 10091 - RNA, 22 nt, Artificial Sequence
  Guide Sequence
auucaucugucucugguuuccc

SEQ ID NO: 10092 - RNA, 22 nt, Artificial Sequence
  Guide Sequence
caaaacagugggaaaagcacga

SEQ ID NO: 10093 - RNA, 22 nt, Artificial Sequence
  Guide Sequence
caaagcaaguggugacacaacc

SEQ ID NO: 10094 - RNA, 22 nt, Artificial Sequence
  Guide Sequence
caaagccacagguccuccucuc

SEQ ID NO: 10095 - RNA, 22 nt, Artificial Sequence
  Guide Sequence
caaagcucuuagaaugucauaa

SEQ ID NO: 10096 - RNA, 22 nt, Artificial Sequence
  Guide Sequence
caaccaaggguuucucucccuc

SEQ ID NO: 10097 - RNA, 22 nt, Artificial Sequence
  Guide Sequence
caaggguuucucucccucuugg

SEQ ID NO: 10098 - RNA, 22 nt, Artificial Sequence
  Guide Sequence
caaguggugacacaaccaaggg

SEQ ID NO: 10099 - RNA, 22 nt, Artificial Sequence
  Guide Sequence
caaguuaucgaaugucacauca

SEQ ID NO: 10100 - RNA, 22 nt, Artificial Sequence
  Guide Sequence
cacaaagcaaguggugacacaa

SEQ ID NO: 10101 - RNA, 22 nt, Artificial Sequence
  Guide Sequence
cacaaagcucuuagaaugucau

SEQ ID NO: 10102 - RNA, 22 nt, Artificial Sequence
  Guide Sequence
cacaaccaaggguuucucuccc

SEQ ID NO: 10103 - RNA, 22 nt, Artificial Sequence
  Guide Sequence
cacacaaagcaaguggugacac

SEQ ID NO: 10104 - RNA, 22 nt, Artificial Sequence
  Guide Sequence
cacagguccuccucucacaaag

SEQ ID NO: 10105 - RNA, 22 nt, Artificial Sequence
  Guide Sequence
cacaucacacaaagcaaguggu

SEQ ID NO: 10106 - RNA, 22 nt, Artificial Sequence
  Guide Sequence
cacccagcuccccacucuccag

SEQ ID NO: 10107 - RNA, 22 nt, Artificial Sequence
  Guide Sequence
cacucuccagccaaagaccuaa

SEQ ID NO: 10108 - RNA, 22 nt, Artificial Sequence
  Guide Sequence
cagaggagacagggaaguaugg

SEQ ID NO: 10109 - RNA, 22 nt, Artificial Sequence
  Guide Sequence
cagcuccccacucuccagccaa

SEQ ID NO: 10110 - RNA, 22 nt, Artificial Sequence
  Guide Sequence
cagggaaguaugguuugugcca

SEQ ID NO: 10111 - RNA, 22 nt, Artificial Sequence
  Guide Sequence
caggggucacccagcuccccac

SEQ ID NO: 10112 - RNA, 22 nt, Artificial Sequence
  Guide Sequence
cagguccuccucucacaaagcu

SEQ ID NO: 10113 - RNA, 22 nt, Artificial Sequence
  Guide Sequence
cagugggaaaagcacgauucag

SEQ ID NO: 10114 - RNA, 22 nt, Artificial Sequence
  Guide Sequence
cauaaaaacuuggaguaccaag

SEQ ID NO: 10115 - RNA, 22 nt, Artificial Sequence
  Guide Sequence
caucacacaaagcaagugguga

SEQ ID NO: 10116 - RNA, 22 nt, Artificial Sequence
  Guide Sequence
caucugucucugguuuccccug

SEQ ID NO: 10117 - RNA, 22 nt, Artificial Sequence
  Guide Sequence
cauucaucugucucugguuucc

SEQ ID NO: 10118 - RNA, 22 nt, Artificial Sequence
  Guide Sequence
ccaaaacagugggaaaagcacg

SEQ ID NO: 10119 - RNA, 22 nt, Artificial Sequence
  Guide Sequence
ccaaggguuucucucccucuug

SEQ ID NO: 10120 - RNA, 22 nt, Artificial Sequence
  Guide Sequence
ccaaguuaucgaaugucacauc

SEQ ID NO: 10121 - RNA, 22 nt, Artificial Sequence
  Guide Sequence
ccacagguccuccucucacaaa

SEQ ID NO: 10122 - RNA, 22 nt, Artificial Sequence
  Guide Sequence
ccacucuccagccaaagaccua

SEQ ID NO: 10123 - RNA, 22 nt, Artificial Sequence
  Guide Sequence
ccagcuccccacucuccagcca

SEQ ID NO: 10124 - RNA, 22 nt, Artificial Sequence
  Guide Sequence
ccaggggucacccagcucccca

SEQ ID NO: 10125 - RNA, 22 nt, Artificial Sequence
  Guide Sequence
cccacucuccagccaaagaccu

SEQ ID NO: 10126 - RNA, 22 nt, Artificial Sequence
  Guide Sequence
cccagcuccccacucuccagcc

SEQ ID NO: 10127 - RNA, 22 nt, Artificial Sequence
  Guide Sequence
ccccacucuccagccaaagacc

SEQ ID NO: 10128 - RNA, 22 nt, Artificial Sequence
  Guide Sequence
ccccugaggcucaaagccacag

SEQ ID NO: 10129 - RNA, 22 nt, Artificial Sequence
  Guide Sequence
cccucuuggggcgggaaagagc

SEQ ID NO: 10130 - RNA, 22 nt, Artificial Sequence
  Guide Sequence
cccugaggcucaaagccacagg

SEQ ID NO: 10131 - RNA, 22 nt, Artificial Sequence
  Guide Sequence
ccuccucucacaaagcucuuag

SEQ ID NO: 10132 - RNA, 22 nt, Artificial Sequence
  Guide Sequence
ccucucacaaagcucuuagaau

SEQ ID NO: 10133 - RNA, 22 nt, Artificial Sequence
  Guide Sequence
ccucuuggggcgggaaagagcu

SEQ ID NO: 10134 - RNA, 22 nt, Artificial Sequence
  Guide Sequence
ccugaggcucaaagccacaggu

SEQ ID NO: 10135 - RNA, 22 nt, Artificial Sequence
  Guide Sequence
cgaaugucacaucacacaaagc

SEQ ID NO: 10136 - RNA, 22 nt, Artificial Sequence
  Guide Sequence
cgggaaagagcucagaggagac

SEQ ID NO: 10137 - RNA, 22 nt, Artificial Sequence
  Guide Sequence
cuaagaccaaaacagugggaaa

SEQ ID NO: 10138 - RNA, 22 nt, Artificial Sequence
  Guide Sequence
cucaaagccacagguccuccuc

SEQ ID NO: 10139 - RNA, 22 nt, Artificial Sequence
  Guide Sequence
cucacaaagcucuuagaauguc

SEQ ID NO: 10140 - RNA, 22 nt, Artificial Sequence
  Guide Sequence
cucagaggagacagggaaguau

SEQ ID NO: 10141 - RNA, 22 nt, Artificial Sequence
  Guide Sequence
cuccccacucuccagccaaaga

SEQ ID NO: 10142 - RNA, 22 nt, Artificial Sequence
  Guide Sequence
cucccucuuggggcgggaaaga

SEQ ID NO: 10143 - RNA, 22 nt, Artificial Sequence
  Guide Sequence
cuccucucacaaagcucuuaga

SEQ ID NO: 10144 - RNA, 22 nt, Artificial Sequence
  Guide Sequence
cucucacaaagcucuuagaaug

SEQ ID NO: 10145 - RNA, 22 nt, Artificial Sequence
  Guide Sequence
cucucccucuuggggcgggaaa

SEQ ID NO: 10146 - RNA, 22 nt, Artificial Sequence
  Guide Sequence
cucugguuuccccugaggcuca

SEQ ID NO: 10147 - RNA, 22 nt, Artificial Sequence
  Guide Sequence
cucuuggggcgggaaagagcuc

SEQ ID NO: 10148 - RNA, 22 nt, Artificial Sequence
  Guide Sequence
cugaggcucaaagccacagguc

SEQ ID NO: 10149 - RNA, 22 nt, Artificial Sequence
  Guide Sequence
cugguuuccccugaggcucaaa

SEQ ID NO: 10150 - RNA, 22 nt, Artificial Sequence
  Guide Sequence
cugucucugguuuccccugagg

SEQ ID NO: 10151 - RNA, 22 nt, Artificial Sequence
  Guide Sequence
cuuggaguaccaaguuaucgaa

SEQ ID NO: 10152 - RNA, 22 nt, Artificial Sequence
  Guide Sequence
cuuggggcgggaaagagcucag

SEQ ID NO: 10153 - RNA, 22 nt, Artificial Sequence
  Guide Sequence
gaaagagcucagaggagacagg

SEQ ID NO: 10154 - RNA, 22 nt, Artificial Sequence
  Guide Sequence
gaaguaugguuugugccagggg

SEQ ID NO: 10155 - RNA, 22 nt, Artificial Sequence
  Guide Sequence
gaaugucacaucacacaaagca

SEQ ID NO: 10156 - RNA, 22 nt, Artificial Sequence
  Guide Sequence
gaaugucauaaaaacuuggagu

SEQ ID NO: 10157 - RNA, 22 nt, Artificial Sequence
  Guide Sequence
gacacaaccaaggguuucucuc

SEQ ID NO: 10158 - RNA, 22 nt, Artificial Sequence
  Guide Sequence
gacagggaaguaugguuugugc

SEQ ID NO: 10159 - RNA, 22 nt, Artificial Sequence
  Guide Sequence
gaccaaaacagugggaaaagca

SEQ ID NO: 10160 - RNA, 22 nt, Artificial Sequence
  Guide Sequence
gagacagggaaguaugguuugu

SEQ ID NO: 10161 - RNA, 22 nt, Artificial Sequence
  Guide Sequence
gagcucagaggagacagggaag

SEQ ID NO: 10162 - RNA, 22 nt, Artificial Sequence
  Guide Sequence
gaggagacagggaaguaugguu

SEQ ID NO: 10163 - RNA, 22 nt, Artificial Sequence
  Guide Sequence
gaggcucaaagccacagguccu

SEQ ID NO: 10164 - RNA, 22 nt, Artificial Sequence
  Guide Sequence
gaguaccaaguuaucgaauguc

SEQ ID NO: 10165 - RNA, 22 nt, Artificial Sequence
  Guide Sequence
gcaaguggugacacaaccaagg

SEQ ID NO: 10166 - RNA, 22 nt, Artificial Sequence
  Guide Sequence
gccacagguccuccucucacaa

SEQ ID NO: 10167 - RNA, 22 nt, Artificial Sequence
  Guide Sequence
gccaggggucacccagcucccc

SEQ ID NO: 10168 - RNA, 22 nt, Artificial Sequence
  Guide Sequence
gcgggaaagagcucagaggaga

SEQ ID NO: 10169 - RNA, 22 nt, Artificial Sequence
  Guide Sequence
gcucaaagccacagguccuccu

SEQ ID NO: 10170 - RNA, 22 nt, Artificial Sequence
  Guide Sequence
gcucagaggagacagggaagua

SEQ ID NO: 10171 - RNA, 22 nt, Artificial Sequence
  Guide Sequence
gcuccccacucuccagccaaag

SEQ ID NO: 10172 - RNA, 22 nt, Artificial Sequence
  Guide Sequence
gcucuuagaaugucauaaaaac

SEQ ID NO: 10173 - RNA, 22 nt, Artificial Sequence
  Guide Sequence
ggaaagagcucagaggagacag

SEQ ID NO: 10174 - RNA, 22 nt, Artificial Sequence
  Guide Sequence
ggaaguaugguuugugccaggg

SEQ ID NO: 10175 - RNA, 22 nt, Artificial Sequence
  Guide Sequence
ggagacagggaaguaugguuug

SEQ ID NO: 10176 - RNA, 22 nt, Artificial Sequence
  Guide Sequence
ggaguaccaaguuaucgaaugu

SEQ ID NO: 10177 - RNA, 22 nt, Artificial Sequence
  Guide Sequence
ggcgggaaagagcucagaggag

SEQ ID NO: 10178 - RNA, 22 nt, Artificial Sequence
  Guide Sequence
ggcucaaagccacagguccucc

SEQ ID NO: 10179 - RNA, 22 nt, Artificial Sequence
  Guide Sequence
gggaaagagcucagaggagaca

SEQ ID NO: 10180 - RNA, 22 nt, Artificial Sequence
  Guide Sequence
gggaaguaugguuugugccagg

SEQ ID NO: 10181 - RNA, 22 nt, Artificial Sequence
  Guide Sequence
gggcgggaaagagcucagagga

SEQ ID NO: 10182 - RNA, 22 nt, Artificial Sequence
  Guide Sequence
ggggcgggaaagagcucagagg

SEQ ID NO: 10183 - RNA, 22 nt, Artificial Sequence
  Guide Sequence
ggggucacccagcuccccacuc

SEQ ID NO: 10184 - RNA, 22 nt, Artificial Sequence
  Guide Sequence
gggucacccagcuccccacucu

SEQ ID NO: 10185 - RNA, 22 nt, Artificial Sequence
  Guide Sequence
ggguuucucucccucuuggggc

SEQ ID NO: 10186 - RNA, 22 nt, Artificial Sequence
  Guide Sequence
ggucacccagcuccccacucuc

SEQ ID NO: 10187 - RNA, 22 nt, Artificial Sequence
  Guide Sequence
gguccuccucucacaaagcucu

SEQ ID NO: 10188 - RNA, 22 nt, Artificial Sequence
  Guide Sequence
ggugacacaaccaaggguuucu

SEQ ID NO: 10189 - RNA, 22 nt, Artificial Sequence
  Guide Sequence
gguuuccccugaggcucaaagc

SEQ ID NO: 10190 - RNA, 22 nt, Artificial Sequence
  Guide Sequence
gguuucucucccucuuggggcg

SEQ ID NO: 10191 - RNA, 22 nt, Artificial Sequence
  Guide Sequence
gguuugugccaggggucaccca

SEQ ID NO: 10192 - RNA, 22 nt, Artificial Sequence
  Guide Sequence
guaccaaguuaucgaaugucac

SEQ ID NO: 10193 - RNA, 22 nt, Artificial Sequence
  Guide Sequence
guaugguuugugccagggguca

SEQ ID NO: 10194 - RNA, 22 nt, Artificial Sequence
  Guide Sequence
gucacaucacacaaagcaagug

SEQ ID NO: 10195 - RNA, 22 nt, Artificial Sequence
  Guide Sequence
gucacccagcuccccacucucc

SEQ ID NO: 10196 - RNA, 22 nt, Artificial Sequence
  Guide Sequence
gucauaaaaacuuggaguacca

SEQ ID NO: 10197 - RNA, 22 nt, Artificial Sequence
  Guide Sequence
guccuccucucacaaagcucuu

SEQ ID NO: 10198 - RNA, 22 nt, Artificial Sequence
  Guide Sequence
gucucugguuuccccugaggcu

SEQ ID NO: 10199 - RNA, 22 nt, Artificial Sequence
  Guide Sequence
gugacacaaccaaggguuucuc

SEQ ID NO: 10200 - RNA, 22 nt, Artificial Sequence
  Guide Sequence
gugccaggggucacccagcucc

SEQ ID NO: 10201 - RNA, 22 nt, Artificial Sequence
  Guide Sequence
gugggaaaagcacgauucaguc

SEQ ID NO: 10202 - RNA, 22 nt, Artificial Sequence
  Guide Sequence
guggugacacaaccaaggguuu

SEQ ID NO: 10203 - RNA, 22 nt, Artificial Sequence
  Guide Sequence
guuaucgaaugucacaucacac

SEQ ID NO: 10204 - RNA, 22 nt, Artificial Sequence
  Guide Sequence
guuuccccugaggcucaaagcc

SEQ ID NO: 10205 - RNA, 22 nt, Artificial Sequence
  Guide Sequence
guuucucucccucuuggggcgg

SEQ ID NO: 10206 - RNA, 22 nt, Artificial Sequence
  Guide Sequence
guuugugccaggggucacccag

SEQ ID NO: 10207 - RNA, 22 nt, Artificial Sequence
  Guide Sequence
uaaaaacuuggaguaccaaguu

SEQ ID NO: 10208 - RNA, 22 nt, Artificial Sequence
  Guide Sequence
uaagaccaaaacagugggaaaa

SEQ ID NO: 10209 - RNA, 22 nt, Artificial Sequence
  Guide Sequence
uaccaaguuaucgaaugucaca

SEQ ID NO: 10210 - RNA, 22 nt, Artificial Sequence
  Guide Sequence
uaucgaaugucacaucacacaa

SEQ ID NO: 10211 - RNA, 22 nt, Artificial Sequence
  Guide Sequence
uaugguuugugccaggggucac

SEQ ID NO: 10212 - RNA, 22 nt, Artificial Sequence
  Guide Sequence
ucaaagccacagguccuccucu

SEQ ID NO: 10213 - RNA, 22 nt, Artificial Sequence
  Guide Sequence
ucacaaagcucuuagaauguca

SEQ ID NO: 10214 - RNA, 22 nt, Artificial Sequence
  Guide Sequence
ucacacaaagcaaguggugaca

SEQ ID NO: 10215 - RNA, 22 nt, Artificial Sequence
  Guide Sequence
ucacaucacacaaagcaagugg

SEQ ID NO: 10216 - RNA, 22 nt, Artificial Sequence
  Guide Sequence
ucacccagcuccccacucucca

SEQ ID NO: 10217 - RNA, 22 nt, Artificial Sequence
  Guide Sequence
ucagaggagacagggaaguaug

SEQ ID NO: 10218 - RNA, 22 nt, Artificial Sequence
  Guide Sequence
ucauaaaaacuuggaguaccaa

SEQ ID NO: 10219 - RNA, 22 nt, Artificial Sequence
  Guide Sequence
ucaucugucucugguuuccccu

SEQ ID NO: 10220 - RNA, 22 nt, Artificial Sequence
  Guide Sequence
uccagccaaagaccuaaguucc

SEQ ID NO: 10221 - RNA, 22 nt, Artificial Sequence
  Guide Sequence
uccccacucuccagccaaagac

SEQ ID NO: 10222 - RNA, 22 nt, Artificial Sequence
  Guide Sequence
uccccugaggcucaaagccaca

SEQ ID NO: 10223 - RNA, 22 nt, Artificial Sequence
  Guide Sequence
ucccucuuggggcgggaaagag

SEQ ID NO: 10224 - RNA, 22 nt, Artificial Sequence
  Guide Sequence
uccuccucucacaaagcucuua

SEQ ID NO: 10225 - RNA, 22 nt, Artificial Sequence
  Guide Sequence
uccucucacaaagcucuuagaa

SEQ ID NO: 10226 - RNA, 22 nt, Artificial Sequence
  Guide Sequence
ucgaaugucacaucacacaaag

SEQ ID NO: 10227 - RNA, 22 nt, Artificial Sequence
  Guide Sequence
ucucacaaagcucuuagaaugu

SEQ ID NO: 10228 - RNA, 22 nt, Artificial Sequence
  Guide Sequence
ucucccucuuggggcgggaaag

SEQ ID NO: 10229 - RNA, 22 nt, Artificial Sequence
  Guide Sequence
ucucucccucuuggggcgggaa

SEQ ID NO: 10230 - RNA, 22 nt, Artificial Sequence
  Guide Sequence
ucucugguuuccccugaggcuc

SEQ ID NO: 10231 - RNA, 22 nt, Artificial Sequence
  Guide Sequence
ucugguuuccccugaggcucaa

SEQ ID NO: 10232 - RNA, 22 nt, Artificial Sequence
  Guide Sequence
ucugucucugguuuccccugag

SEQ ID NO: 10233 - RNA, 22 nt, Artificial Sequence
  Guide Sequence
ucuuggggcgggaaagagcuca

SEQ ID NO: 10234 - RNA, 22 nt, Artificial Sequence
  Guide Sequence
ugacacaaccaaggguuucucu

SEQ ID NO: 10235 - RNA, 22 nt, Artificial Sequence
  Guide Sequence
ugaggcucaaagccacaggucc

SEQ ID NO: 10236 - RNA, 22 nt, Artificial Sequence
  Guide Sequence
ugccaggggucacccagcuccc

SEQ ID NO: 10237 - RNA, 22 nt, Artificial Sequence
  Guide Sequence
uggaguaccaaguuaucgaaug

SEQ ID NO: 10238 - RNA, 22 nt, Artificial Sequence
  Guide Sequence
ugggaaaagcacgauucaguca

SEQ ID NO: 10239 - RNA, 22 nt, Artificial Sequence
  Guide Sequence
uggggcgggaaagagcucagag

SEQ ID NO: 10240 - RNA, 22 nt, Artificial Sequence
  Guide Sequence
uggugacacaaccaaggguuuc

SEQ ID NO: 10241 - RNA, 22 nt, Artificial Sequence
  Guide Sequence
ugguuuccccugaggcucaaag

SEQ ID NO: 10242 - RNA, 22 nt, Artificial Sequence
  Guide Sequence
ugguuugugccaggggucaccc

SEQ ID NO: 10243 - RNA, 22 nt, Artificial Sequence
  Guide Sequence
ugucacaucacacaaagcaagu

SEQ ID NO: 10244 - RNA, 22 nt, Artificial Sequence
  Guide Sequence
ugucauaaaaacuuggaguacc

SEQ ID NO: 10245 - RNA, 22 nt, Artificial Sequence
  Guide Sequence
ugucucugguuuccccugaggc

SEQ ID NO: 10246 - RNA, 22 nt, Artificial Sequence
  Guide Sequence
ugugccaggggucacccagcuc

SEQ ID NO: 10247 - RNA, 22 nt, Artificial Sequence
  Guide Sequence
uuaucgaaugucacaucacaca

SEQ ID NO: 10248 - RNA, 22 nt, Artificial Sequence
  Guide Sequence
uucaucugucucugguuucccc

SEQ ID NO: 10249 - RNA, 22 nt, Artificial Sequence
  Guide Sequence
uuccccugaggcucaaagccac

SEQ ID NO: 10250 - RNA, 22 nt, Artificial Sequence
  Guide Sequence
uucucucccucuuggggcggga

SEQ ID NO: 10251 - RNA, 22 nt, Artificial Sequence
  Guide Sequence
uuggaguaccaaguuaucgaau

SEQ ID NO: 10252 - RNA, 22 nt, Artificial Sequence
  Guide Sequence
uuggggcgggaaagagcucaga

SEQ ID NO: 10253 - RNA, 22 nt, Artificial Sequence
  Guide Sequence
uugugccaggggucacccagcu

SEQ ID NO: 10254 - RNA, 22 nt, Artificial Sequence
  Guide Sequence
uuuccccugaggcucaaagcca

SEQ ID NO: 10255 - RNA, 22 nt, Artificial Sequence
  Guide Sequence
uuucucucccucuuggggcggg

SEQ ID NO: 10256 - RNA, 22 nt, Artificial Sequence
  Guide Sequence
uuugugccaggggucacccagc

SEQ ID NO: 10257 - RNA, 20 nt, Artificial Sequence
  Guide Sequence
aaaacacacacuaacaccca

SEQ ID NO: 10258 - RNA, 20 nt, Artificial Sequence
  Guide Sequence
aaaaguuaacgagcaggcua

SEQ ID NO: 10259 - RNA, 20 nt, Artificial Sequence
  Guide Sequence
aaacaauuccuuguguguaa

SEQ ID NO: 10260 - RNA, 20 nt, Artificial Sequence
  Guide Sequence
aaacacacacuaacacccag

SEQ ID NO: 10261 - RNA, 20 nt, Artificial Sequence
  Guide Sequence
aaacagcccugcacccuggg

SEQ ID NO: 10262 - RNA, 20 nt, Artificial Sequence
  Guide Sequence
aaacagcuaauucucacugu

SEQ ID NO: 10263 - RNA, 20 nt, Artificial Sequence
  Guide Sequence
aaacugaaaacacacacuaa

SEQ ID NO: 10264 - RNA, 20 nt, Artificial Sequence
  Guide Sequence
aaacugacagcccccucucc

SEQ ID NO: 10265 - RNA, 20 nt, Artificial Sequence
  Guide Sequence
aaagcagauagucgcuaaau

SEQ ID NO: 10266 - RNA, 20 nt, Artificial Sequence
  Guide Sequence
aaaguuaacgagcaggcuaa

SEQ ID NO: 10267 - RNA, 20 nt, Artificial Sequence
  Guide Sequence
aaauuacccuccuggagccu

SEQ ID NO: 10268 - RNA, 20 nt, Artificial Sequence
  Guide Sequence
aacaauuccuuguguguaaa

SEQ ID NO: 10269 - RNA, 20 nt, Artificial Sequence
  Guide Sequence
aacacacacuaacacccaga

SEQ ID NO: 10270 - RNA, 20 nt, Artificial Sequence
  Guide Sequence
aacacccagaaacugacagc

SEQ ID NO: 10271 - RNA, 20 nt, Artificial Sequence
  Guide Sequence
aacagcccugcacccugggu

SEQ ID NO: 10272 - RNA, 20 nt, Artificial Sequence
  Guide Sequence
aacagcuaauucucacuguu

SEQ ID NO: 10273 - RNA, 20 nt, Artificial Sequence
  Guide Sequence
aacgagcaggcuaaugaaag

SEQ ID NO: 10274 - RNA, 20 nt, Artificial Sequence
  Guide Sequence
aacugaaaacacacacuaac

SEQ ID NO: 10275 - RNA, 20 nt, Artificial Sequence
  Guide Sequence
aacugacagcccccucuccu

SEQ ID NO: 10276 - RNA, 20 nt, Artificial Sequence
  Guide Sequence
aagaagggaaacugaaaaca

SEQ ID NO: 10277 - RNA, 20 nt, Artificial Sequence
  Guide Sequence
aagcagauagucgcuaaauu

SEQ ID NO: 10278 - RNA, 20 nt, Artificial Sequence
  Guide Sequence
aaggcuacuccaucaaugca

SEQ ID NO: 10279 - RNA, 20 nt, Artificial Sequence
  Guide Sequence
aagggaaacugaaaacacac

SEQ ID NO: 10280 - RNA, 20 nt, Artificial Sequence
  Guide Sequence
aagggucuugaucaaggucu

SEQ ID NO: 10281 - RNA, 20 nt, Artificial Sequence
  Guide Sequence
aaggucucagguaaacaauu

SEQ ID NO: 10282 - RNA, 20 nt, Artificial Sequence
  Guide Sequence
aaguuaacgagcaggcuaau

SEQ ID NO: 10283 - RNA, 20 nt, Artificial Sequence
  Guide Sequence
aauccccuccugccugccuc

SEQ ID NO: 10284 - RNA, 20 nt, Artificial Sequence
  Guide Sequence
aaugaaagcagauagucgcu

SEQ ID NO: 10285 - RNA, 20 nt, Artificial Sequence
  Guide Sequence
aauuacccuccuggagccug

SEQ ID NO: 10286 - RNA, 20 nt, Artificial Sequence
  Guide Sequence
aauuccuuguguguaaacag

SEQ ID NO: 10287 - RNA, 20 nt, Artificial Sequence
  Guide Sequence
aauugaugaccgggccucaa

SEQ ID NO: 10288 - RNA, 20 nt, Artificial Sequence
  Guide Sequence
acaaacagcccugcacccug

SEQ ID NO: 10289 - RNA, 20 nt, Artificial Sequence
  Guide Sequence
acaauuccuuguguguaaac

SEQ ID NO: 10290 - RNA, 20 nt, Artificial Sequence
  Guide Sequence
acacacacuaacacccagaa

SEQ ID NO: 10291 - RNA, 20 nt, Artificial Sequence
  Guide Sequence
acacacuaacacccagaaac

SEQ ID NO: 10292 - RNA, 20 nt, Artificial Sequence
  Guide Sequence
acacccagaaacugacagcc

SEQ ID NO: 10293 - RNA, 20 nt, Artificial Sequence
  Guide Sequence
acacuaacacccagaaacug

SEQ ID NO: 10294 - RNA, 20 nt, Artificial Sequence
  Guide Sequence
acagcccccucuccucaccc

SEQ ID NO: 10295 - RNA, 20 nt, Artificial Sequence
  Guide Sequence
acagcccugcacccugggug

SEQ ID NO: 10296 - RNA, 20 nt, Artificial Sequence
  Guide Sequence
acagcuaauucucacuguuu

SEQ ID NO: 10297 - RNA, 20 nt, Artificial Sequence
  Guide Sequence
accaucuccagggccaacuu

SEQ ID NO: 10298 - RNA, 20 nt, Artificial Sequence
  Guide Sequence
accauucguuggggaauuga

SEQ ID NO: 10299 - RNA, 20 nt, Artificial Sequence
  Guide Sequence
acccagaaacugacagcccc

SEQ ID NO: 10300 - RNA, 20 nt, Artificial Sequence
  Guide Sequence
acccuccuggagccugggcu

SEQ ID NO: 10301 - RNA, 20 nt, Artificial Sequence
  Guide Sequence
acccugggugggcacuccca

SEQ ID NO: 10302 - RNA, 20 nt, Artificial Sequence
  Guide Sequence
accgggccucaaggcuacuc

SEQ ID NO: 10303 - RNA, 20 nt, Artificial Sequence
  Guide Sequence
acgagcaggcuaaugaaagc

SEQ ID NO: 10304 - RNA, 20 nt, Artificial Sequence
  Guide Sequence
acuaacacccagaaacugac

SEQ ID NO: 10305 - RNA, 20 nt, Artificial Sequence
  Guide Sequence
acuaugcaggaccauucguu

SEQ ID NO: 10306 - RNA, 20 nt, Artificial Sequence
  Guide Sequence
acucccaccaucuccagggc

SEQ ID NO: 10307 - RNA, 20 nt, Artificial Sequence
  Guide Sequence
acugaaaacacacacuaaca

SEQ ID NO: 10308 - RNA, 20 nt, Artificial Sequence
  Guide Sequence
acugacagcccccucuccuc

SEQ ID NO: 10309 - RNA, 20 nt, Artificial Sequence
  Guide Sequence
acuguuuuauaagaagggaa

SEQ ID NO: 10310 - RNA, 20 nt, Artificial Sequence
  Guide Sequence
agaaacugacagcccccucu

SEQ ID NO: 10311 - RNA, 20 nt, Artificial Sequence
  Guide Sequence
agaagggaaacugaaaacac

SEQ ID NO: 10312 - RNA, 20 nt, Artificial Sequence
  Guide Sequence
agaauccccuccugccugcc

SEQ ID NO: 10313 - RNA, 20 nt, Artificial Sequence
  Guide Sequence
agacuaugcaggaccauucg

SEQ ID NO: 10314 - RNA, 20 nt, Artificial Sequence
  Guide Sequence
agagaggucggggugaggcc

SEQ ID NO: 10315 - RNA, 20 nt, Artificial Sequence
  Guide Sequence
agagggagauuuaagggucu

SEQ ID NO: 10316 - RNA, 20 nt, Artificial Sequence
  Guide Sequence
agaggucggggugaggcccc

SEQ ID NO: 10317 - RNA, 20 nt, Artificial Sequence
  Guide Sequence
agauagucgcuaaauuaccc

SEQ ID NO: 10318 - RNA, 20 nt, Artificial Sequence
  Guide Sequence
agauuuaagggucuugauca

SEQ ID NO: 10319 - RNA, 20 nt, Artificial Sequence
  Guide Sequence
agcagauagucgcuaaauua

SEQ ID NO: 10320 - RNA, 20 nt, Artificial Sequence
  Guide Sequence
agcaggcuaaugaaagcaga

SEQ ID NO: 10321 - RNA, 20 nt, Artificial Sequence
  Guide Sequence
agccagagaggucgggguga

SEQ ID NO: 10322 - RNA, 20 nt, Artificial Sequence
  Guide Sequence
agcccccucuccucacccac

SEQ ID NO: 10323 - RNA, 20 nt, Artificial Sequence
  Guide Sequence
agcccugcacccuggguggg

SEQ ID NO: 10324 - RNA, 20 nt, Artificial Sequence
  Guide Sequence
agccugggcuagucagccag

SEQ ID NO: 10325 - RNA, 20 nt, Artificial Sequence
  Guide Sequence
agcuaauucucacuguuuua

SEQ ID NO: 10326 - RNA, 20 nt, Artificial Sequence
  Guide Sequence
agcucuuccuugacaaacag

SEQ ID NO: 10327 - RNA, 20 nt, Artificial Sequence
  Guide Sequence
aggaccauucguuggggaau

SEQ ID NO: 10328 - RNA, 20 nt, Artificial Sequence
  Guide Sequence
aggaggggccugaggggcug

SEQ ID NO: 10329 - RNA, 20 nt, Artificial Sequence
  Guide Sequence
aggccccgugcuguuugcuu

SEQ ID NO: 10330 - RNA, 20 nt, Artificial Sequence
  Guide Sequence
aggcuaaugaaagcagauag

SEQ ID NO: 10331 - RNA, 20 nt, Artificial Sequence
  Guide Sequence
aggcuacuccaucaaugcag

SEQ ID NO: 10332 - RNA, 20 nt, Artificial Sequence
  Guide Sequence
agggaaacugaaaacacaca

SEQ ID NO: 10333 - RNA, 20 nt, Artificial Sequence
  Guide Sequence
agggagauuuaagggucuug

SEQ ID NO: 10334 - RNA, 20 nt, Artificial Sequence
  Guide Sequence
agggccaacuucuuuagugg

SEQ ID NO: 10335 - RNA, 20 nt, Artificial Sequence
  Guide Sequence
aggggccugaggggcugggc

SEQ ID NO: 10336 - RNA, 20 nt, Artificial Sequence
  Guide Sequence
aggggcugggcagacuaugc

SEQ ID NO: 10337 - RNA, 20 nt, Artificial Sequence
  Guide Sequence
agggucuugaucaaggucuc

SEQ ID NO: 10338 - RNA, 20 nt, Artificial Sequence
  Guide Sequence
agguaaacaauuccuugugu

SEQ ID NO: 10339 - RNA, 20 nt, Artificial Sequence
  Guide Sequence
aggucggggugaggccccgu

SEQ ID NO: 10340 - RNA, 20 nt, Artificial Sequence
  Guide Sequence
aggucucagguaaacaauuc

SEQ ID NO: 10341 - RNA, 20 nt, Artificial Sequence
  Guide Sequence
agucagccagagaggucggg

SEQ ID NO: 10342 - RNA, 20 nt, Artificial Sequence
  Guide Sequence
agucgcuaaauuacccuccu

SEQ ID NO: 10343 - RNA, 20 nt, Artificial Sequence
  Guide Sequence
agugugagagggagauuuaa

SEQ ID NO: 10344 - RNA, 20 nt, Artificial Sequence
  Guide Sequence
aguuaacgagcaggcuaaug

SEQ ID NO: 10345 - RNA, 20 nt, Artificial Sequence
  Guide Sequence
auaagaagggaaacugaaaa

SEQ ID NO: 10346 - RNA, 20 nt, Artificial Sequence
  Guide Sequence
auaggaggggccugaggggc

SEQ ID NO: 10347 - RNA, 20 nt, Artificial Sequence
  Guide Sequence
auagucgcuaaauuacccuc

SEQ ID NO: 10348 - RNA, 20 nt, Artificial Sequence
  Guide Sequence
aucaaggucucagguaaaca

SEQ ID NO: 10349 - RNA, 20 nt, Artificial Sequence
  Guide Sequence
auccccuccugccugccucu

SEQ ID NO: 10350 - RNA, 20 nt, Artificial Sequence
  Guide Sequence
aucuccagggccaacuucuu

SEQ ID NO: 10351 - RNA, 20 nt, Artificial Sequence
  Guide Sequence
augaaagcagauagucgcua

SEQ ID NO: 10352 - RNA, 20 nt, Artificial Sequence
  Guide Sequence
augaccgggccucaaggcua

SEQ ID NO: 10353 - RNA, 20 nt, Artificial Sequence
  Guide Sequence
augcaggaccauucguuggg

SEQ ID NO: 10354 - RNA, 20 nt, Artificial Sequence
  Guide Sequence
auuacccuccuggagccugg

SEQ ID NO: 10355 - RNA, 20 nt, Artificial Sequence
  Guide Sequence
auuccuuguguguaaacagc

SEQ ID NO: 10356 - RNA, 20 nt, Artificial Sequence
  Guide Sequence
auucguuggggaauugauga

SEQ ID NO: 10357 - RNA, 20 nt, Artificial Sequence
  Guide Sequence
auugaugaccgggccucaag

SEQ ID NO: 10358 - RNA, 20 nt, Artificial Sequence
  Guide Sequence
auuuaagggucuugaucaag

SEQ ID NO: 10359 - RNA, 20 nt, Artificial Sequence
  Guide Sequence
caaacagcccugcacccugg

SEQ ID NO: 10360 - RNA, 20 nt, Artificial Sequence
  Guide Sequence
caacuucuuuagugguuacu

SEQ ID NO: 10361 - RNA, 20 nt, Artificial Sequence
  Guide Sequence
caaggcuacuccaucaaugc

SEQ ID NO: 10362 - RNA, 20 nt, Artificial Sequence
  Guide Sequence
caaggucucagguaaacaau

SEQ ID NO: 10363 - RNA, 20 nt, Artificial Sequence
  Guide Sequence
caauuccuuguguguaaaca

SEQ ID NO: 10364 - RNA, 20 nt, Artificial Sequence
  Guide Sequence
cacacacuaacacccagaaa

SEQ ID NO: 10365 - RNA, 20 nt, Artificial Sequence
  Guide Sequence
cacacuaacacccagaaacu

SEQ ID NO: 10366 - RNA, 20 nt, Artificial Sequence
  Guide Sequence
caccaucuccagggccaacu

SEQ ID NO: 10367 - RNA, 20 nt, Artificial Sequence
  Guide Sequence
cacccagaaacugacagccc

SEQ ID NO: 10368 - RNA, 20 nt, Artificial Sequence
  Guide Sequence
cacccugggugggcacuccc

SEQ ID NO: 10369 - RNA, 20 nt, Artificial Sequence
  Guide Sequence
cacuaacacccagaaacuga

SEQ ID NO: 10370 - RNA, 20 nt, Artificial Sequence
  Guide Sequence
cacucccaccaucuccaggg

SEQ ID NO: 10371 - RNA, 20 nt, Artificial Sequence
  Guide Sequence
cacuguuuuauaagaaggga

SEQ ID NO: 10372 - RNA, 20 nt, Artificial Sequence
  Guide Sequence
cagaaacugacagcccccuc

SEQ ID NO: 10373 - RNA, 20 nt, Artificial Sequence
  Guide Sequence
cagaauccccuccugccugc

SEQ ID NO: 10374 - RNA, 20 nt, Artificial Sequence
  Guide Sequence
cagacuaugcaggaccauuc

SEQ ID NO: 10375 - RNA, 20 nt, Artificial Sequence
  Guide Sequence
cagagaggucggggugaggc

SEQ ID NO: 10376 - RNA, 20 nt, Artificial Sequence
  Guide Sequence
cagauagucgcuaaauuacc

SEQ ID NO: 10377 - RNA, 20 nt, Artificial Sequence
  Guide Sequence
cagccagagaggucggggug

SEQ ID NO: 10378 - RNA, 20 nt, Artificial Sequence
  Guide Sequence
cagcccccucuccucaccca

SEQ ID NO: 10379 - RNA, 20 nt, Artificial Sequence
  Guide Sequence
cagcccugcacccugggugg

SEQ ID NO: 10380 - RNA, 20 nt, Artificial Sequence
  Guide Sequence
cagcuaauucucacuguuuu

SEQ ID NO: 10381 - RNA, 20 nt, Artificial Sequence
  Guide Sequence
caggaccauucguuggggaa

SEQ ID NO: 10382 - RNA, 20 nt, Artificial Sequence
  Guide Sequence
caggcuaaugaaagcagaua

SEQ ID NO: 10383 - RNA, 20 nt, Artificial Sequence
  Guide Sequence
cagggccaacuucuuuagug

SEQ ID NO: 10384 - RNA, 20 nt, Artificial Sequence
  Guide Sequence
cagguaaacaauuccuugug

SEQ ID NO: 10385 - RNA, 20 nt, Artificial Sequence
  Guide Sequence
caucuccagggccaacuucu

SEQ ID NO: 10386 - RNA, 20 nt, Artificial Sequence
  Guide Sequence
cauucguuggggaauugaug

SEQ ID NO: 10387 - RNA, 20 nt, Artificial Sequence
  Guide Sequence
ccaacuucuuuagugguuac

SEQ ID NO: 10388 - RNA, 20 nt, Artificial Sequence
  Guide Sequence
ccaccaucuccagggccaac

SEQ ID NO: 10389 - RNA, 20 nt, Artificial Sequence
  Guide Sequence
ccagaaacugacagcccccu

SEQ ID NO: 10390 - RNA, 20 nt, Artificial Sequence
  Guide Sequence
ccagagaggucggggugagg

SEQ ID NO: 10391 - RNA, 20 nt, Artificial Sequence
  Guide Sequence
ccagggccaacuucuuuagu

SEQ ID NO: 10392 - RNA, 20 nt, Artificial Sequence
  Guide Sequence
ccaucuccagggccaacuuc

SEQ ID NO: 10393 - RNA, 20 nt, Artificial Sequence
  Guide Sequence
ccauucguuggggaauugau

SEQ ID NO: 10394 - RNA, 20 nt, Artificial Sequence
  Guide Sequence
cccaccaucuccagggccaa

SEQ ID NO: 10395 - RNA, 20 nt, Artificial Sequence
  Guide Sequence
cccagaaacugacagccccc

SEQ ID NO: 10396 - RNA, 20 nt, Artificial Sequence
  Guide Sequence
ccccccggcuagcucuuccu

SEQ ID NO: 10397 - RNA, 20 nt, Artificial Sequence
  Guide Sequence
cccccggcuagcucuuccuu

SEQ ID NO: 10398 - RNA, 20 nt, Artificial Sequence
  Guide Sequence
cccccucuccucacccaccc

SEQ ID NO: 10399 - RNA, 20 nt, Artificial Sequence
  Guide Sequence
ccccggcuagcucuuccuug

SEQ ID NO: 10400 - RNA, 20 nt, Artificial Sequence
  Guide Sequence
ccccgugcuguuugcuuuuc

SEQ ID NO: 10401 - RNA, 20 nt, Artificial Sequence
  Guide Sequence
ccccuccugccugccucuga

SEQ ID NO: 10402 - RNA, 20 nt, Artificial Sequence
  Guide Sequence
ccccucuccucacccacccc

SEQ ID NO: 10403 - RNA, 20 nt, Artificial Sequence
  Guide Sequence
cccggcuagcucuuccuuga

SEQ ID NO: 10404 - RNA, 20 nt, Artificial Sequence
  Guide Sequence
cccgugcuguuugcuuuucu

SEQ ID NO: 10405 - RNA, 20 nt, Artificial Sequence
  Guide Sequence
cccuccugccugccucugau

SEQ ID NO: 10406 - RNA, 20 nt, Artificial Sequence
  Guide Sequence
cccuccuggagccugggcua

SEQ ID NO: 10407 - RNA, 20 nt, Artificial Sequence
  Guide Sequence
cccucuccucacccaccccc

SEQ ID NO: 10408 - RNA, 20 nt, Artificial Sequence
  Guide Sequence
cccugcacccugggugggca

SEQ ID NO: 10409 - RNA, 20 nt, Artificial Sequence
  Guide Sequence
cccugggugggcacucccac

SEQ ID NO: 10410 - RNA, 20 nt, Artificial Sequence
  Guide Sequence
ccggcuagcucuuccuugac

SEQ ID NO: 10411 - RNA, 20 nt, Artificial Sequence
  Guide Sequence
ccgggccucaaggcuacucc

SEQ ID NO: 10412 - RNA, 20 nt, Artificial Sequence
  Guide Sequence
ccgugcuguuugcuuuucug

SEQ ID NO: 10413 - RNA, 20 nt, Artificial Sequence
  Guide Sequence
ccucaaggcuacuccaucaa

SEQ ID NO: 10414 - RNA, 20 nt, Artificial Sequence
  Guide Sequence
ccuccugccugccucugaua

SEQ ID NO: 10415 - RNA, 20 nt, Artificial Sequence
  Guide Sequence
ccuccuggagccugggcuag

SEQ ID NO: 10416 - RNA, 20 nt, Artificial Sequence
  Guide Sequence
ccucuccucacccacccccc

SEQ ID NO: 10417 - RNA, 20 nt, Artificial Sequence
  Guide Sequence
ccucugauaggaggggccug

SEQ ID NO: 10418 - RNA, 20 nt, Artificial Sequence
  Guide Sequence
ccugaggggcugggcagacu

SEQ ID NO: 10419 - RNA, 20 nt, Artificial Sequence
  Guide Sequence
ccugcacccugggugggcac

SEQ ID NO: 10420 - RNA, 20 nt, Artificial Sequence
  Guide Sequence
ccugccucugauaggagggg

SEQ ID NO: 10421 - RNA, 20 nt, Artificial Sequence
  Guide Sequence
ccugccugccucugauagga

SEQ ID NO: 10422 - RNA, 20 nt, Artificial Sequence
  Guide Sequence
ccuggagccugggcuaguca

SEQ ID NO: 10423 - RNA, 20 nt, Artificial Sequence
  Guide Sequence
ccugggcuagucagccagag

SEQ ID NO: 10424 - RNA, 20 nt, Artificial Sequence
  Guide Sequence
ccugggugggcacucccacc

SEQ ID NO: 10425 - RNA, 20 nt, Artificial Sequence
  Guide Sequence
ccuugacaaacagcccugca

SEQ ID NO: 10426 - RNA, 20 nt, Artificial Sequence
  Guide Sequence
ccuuguguguaaacagcuaa

SEQ ID NO: 10427 - RNA, 20 nt, Artificial Sequence
  Guide Sequence
cgagcaggcuaaugaaagca

SEQ ID NO: 10428 - RNA, 20 nt, Artificial Sequence
  Guide Sequence
cgcuaaauuacccuccugga

SEQ ID NO: 10429 - RNA, 20 nt, Artificial Sequence
  Guide Sequence
cggcuagcucuuccuugaca

SEQ ID NO: 10430 - RNA, 20 nt, Artificial Sequence
  Guide Sequence
cgggccucaaggcuacucca

SEQ ID NO: 10431 - RNA, 20 nt, Artificial Sequence
  Guide Sequence
cggggugaggccccgugcug

SEQ ID NO: 10432 - RNA, 20 nt, Artificial Sequence
  Guide Sequence
cgugcuguuugcuuuucugc

SEQ ID NO: 10433 - RNA, 20 nt, Artificial Sequence
  Guide Sequence
cguuggggaauugaugaccg

SEQ ID NO: 10434 - RNA, 20 nt, Artificial Sequence
  Guide Sequence
cuaaauuacccuccuggagc

SEQ ID NO: 10435 - RNA, 20 nt, Artificial Sequence
  Guide Sequence
cuaacacccagaaacugaca

SEQ ID NO: 10436 - RNA, 20 nt, Artificial Sequence
  Guide Sequence
cuaaugaaagcagauagucg

SEQ ID NO: 10437 - RNA, 20 nt, Artificial Sequence
  Guide Sequence
cuagcucuuccuugacaaac

SEQ ID NO: 10438 - RNA, 20 nt, Artificial Sequence
  Guide Sequence
cuagucagccagagaggucg

SEQ ID NO: 10439 - RNA, 20 nt, Artificial Sequence
  Guide Sequence
cuaugcaggaccauucguug

SEQ ID NO: 10440 - RNA, 20 nt, Artificial Sequence
  Guide Sequence
cucaaggcuacuccaucaau

SEQ ID NO: 10441 - RNA, 20 nt, Artificial Sequence
  Guide Sequence
cucacuguuuuauaagaagg

SEQ ID NO: 10442 - RNA, 20 nt, Artificial Sequence
  Guide Sequence
cucagguaaacaauuccuug

SEQ ID NO: 10443 - RNA, 20 nt, Artificial Sequence
  Guide Sequence
cuccagggccaacuucuuua

SEQ ID NO: 10444 - RNA, 20 nt, Artificial Sequence
  Guide Sequence
cucccaccaucuccagggcc

SEQ ID NO: 10445 - RNA, 20 nt, Artificial Sequence
  Guide Sequence
cuccugccugccucugauag

SEQ ID NO: 10446 - RNA, 20 nt, Artificial Sequence
  Guide Sequence
cuccuggagccugggcuagu

SEQ ID NO: 10447 - RNA, 20 nt, Artificial Sequence
  Guide Sequence
cucugauaggaggggccuga

SEQ ID NO: 10448 - RNA, 20 nt, Artificial Sequence
  Guide Sequence
cucuuccuugacaaacagcc

SEQ ID NO: 10449 - RNA, 20 nt, Artificial Sequence
  Guide Sequence
cugaaaacacacacuaacac

SEQ ID NO: 10450 - RNA, 20 nt, Artificial Sequence
  Guide Sequence
cugacagcccccucuccuca

SEQ ID NO: 10451 - RNA, 20 nt, Artificial Sequence
  Guide Sequence
cugaggggcugggcagacua

SEQ ID NO: 10452 - RNA, 20 nt, Artificial Sequence
  Guide Sequence
cugauaggaggggccugagg

SEQ ID NO: 10453 - RNA, 20 nt, Artificial Sequence
  Guide Sequence
cugcacccugggugggcacu

SEQ ID NO: 10454 - RNA, 20 nt, Artificial Sequence
  Guide Sequence
cugcagaauccccuccugcc

SEQ ID NO: 10455 - RNA, 20 nt, Artificial Sequence
  Guide Sequence
cugccucugauaggaggggc

SEQ ID NO: 10456 - RNA, 20 nt, Artificial Sequence
  Guide Sequence
cugccugccucugauaggag

SEQ ID NO: 10457 - RNA, 20 nt, Artificial Sequence
  Guide Sequence
cuggagccugggcuagucag

SEQ ID NO: 10458 - RNA, 20 nt, Artificial Sequence
  Guide Sequence
cugggcagacuaugcaggac

SEQ ID NO: 10459 - RNA, 20 nt, Artificial Sequence
  Guide Sequence
cugggcuagucagccagaga

SEQ ID NO: 10460 - RNA, 20 nt, Artificial Sequence
  Guide Sequence
cuggggguagugugagaggg

SEQ ID NO: 10461 - RNA, 20 nt, Artificial Sequence
  Guide Sequence
cugggugggcacucccacca

SEQ ID NO: 10462 - RNA, 20 nt, Artificial Sequence
  Guide Sequence
cuguuugcuuuucugcagaa

SEQ ID NO: 10463 - RNA, 20 nt, Artificial Sequence
  Guide Sequence
cuguuuuauaagaagggaaa

SEQ ID NO: 10464 - RNA, 20 nt, Artificial Sequence
  Guide Sequence
cuuccuugacaaacagcccu

SEQ ID NO: 10465 - RNA, 20 nt, Artificial Sequence
  Guide Sequence
cuugacaaacagcccugcac

SEQ ID NO: 10466 - RNA, 20 nt, Artificial Sequence
  Guide Sequence
cuugaucaaggucucaggua

SEQ ID NO: 10467 - RNA, 20 nt, Artificial Sequence
  Guide Sequence
cuuguguguaaacagcuaau

SEQ ID NO: 10468 - RNA, 20 nt, Artificial Sequence
  Guide Sequence
cuuuucugcagaauccccuc

SEQ ID NO: 10469 - RNA, 20 nt, Artificial Sequence
  Guide Sequence
gaaaacacacacuaacaccc

SEQ ID NO: 10470 - RNA, 20 nt, Artificial Sequence
  Guide Sequence
gaaaaguuaacgagcaggcu

SEQ ID NO: 10471 - RNA, 20 nt, Artificial Sequence
  Guide Sequence
gaaacugaaaacacacacua

SEQ ID NO: 10472 - RNA, 20 nt, Artificial Sequence
  Guide Sequence
gaaacugacagcccccucuc

SEQ ID NO: 10473 - RNA, 20 nt, Artificial Sequence
  Guide Sequence
gaaagcagauagucgcuaaa

SEQ ID NO: 10474 - RNA, 20 nt, Artificial Sequence
  Guide Sequence
gaagggaaacugaaaacaca

SEQ ID NO: 10475 - RNA, 20 nt, Artificial Sequence
  Guide Sequence
gaauccccuccugccugccu

SEQ ID NO: 10476 - RNA, 20 nt, Artificial Sequence
  Guide Sequence
gaauugaugaccgggccuca

SEQ ID NO: 10477 - RNA, 20 nt, Artificial Sequence
  Guide Sequence
gacaaacagcccugcacccu

SEQ ID NO: 10478 - RNA, 20 nt, Artificial Sequence
  Guide Sequence
gacagcccccucuccucacc

SEQ ID NO: 10479 - RNA, 20 nt, Artificial Sequence
  Guide Sequence
gaccauucguuggggaauug

SEQ ID NO: 10480 - RNA, 20 nt, Artificial Sequence
  Guide Sequence
gaccgggccucaaggcuacu

SEQ ID NO: 10481 - RNA, 20 nt, Artificial Sequence
  Guide Sequence
gacuaugcaggaccauucgu

SEQ ID NO: 10482 - RNA, 20 nt, Artificial Sequence
  Guide Sequence
gagagggagauuuaaggguc

SEQ ID NO: 10483 - RNA, 20 nt, Artificial Sequence
  Guide Sequence
gagaggucggggugaggccc

SEQ ID NO: 10484 - RNA, 20 nt, Artificial Sequence
  Guide Sequence
gagauuuaagggucuugauc

SEQ ID NO: 10485 - RNA, 20 nt, Artificial Sequence
  Guide Sequence
gagcaggcuaaugaaagcag

SEQ ID NO: 10486 - RNA, 20 nt, Artificial Sequence
  Guide Sequence
gagccugggcuagucagcca

SEQ ID NO: 10487 - RNA, 20 nt, Artificial Sequence
  Guide Sequence
gaggccccgugcuguuugcu

SEQ ID NO: 10488 - RNA, 20 nt, Artificial Sequence
  Guide Sequence
gagggagauuuaagggucuu

SEQ ID NO: 10489 - RNA, 20 nt, Artificial Sequence
  Guide Sequence
gaggggccugaggggcuggg

SEQ ID NO: 10490 - RNA, 20 nt, Artificial Sequence
  Guide Sequence
gaggggcugggcagacuaug

SEQ ID NO: 10491 - RNA, 20 nt, Artificial Sequence
  Guide Sequence
gaggucggggugaggccccg

SEQ ID NO: 10492 - RNA, 20 nt, Artificial Sequence
  Guide Sequence
gauaggaggggccugagggg

SEQ ID NO: 10493 - RNA, 20 nt, Artificial Sequence
  Guide Sequence
gauagucgcuaaauuacccu

SEQ ID NO: 10494 - RNA, 20 nt, Artificial Sequence
  Guide Sequence
gaucaaggucucagguaaac

SEQ ID NO: 10495 - RNA, 20 nt, Artificial Sequence
  Guide Sequence
gaugaccgggccucaaggcu

SEQ ID NO: 10496 - RNA, 20 nt, Artificial Sequence
  Guide Sequence
gauuuaagggucuugaucaa

SEQ ID NO: 10497 - RNA, 20 nt, Artificial Sequence
  Guide Sequence
gcacccugggugggcacucc

SEQ ID NO: 10498 - RNA, 20 nt, Artificial Sequence
  Guide Sequence
gcacucccaccaucuccagg

SEQ ID NO: 10499 - RNA, 20 nt, Artificial Sequence
  Guide Sequence
gcagaauccccuccugccug

SEQ ID NO: 10500 - RNA, 20 nt, Artificial Sequence
  Guide Sequence
gcagacuaugcaggaccauu

SEQ ID NO: 10501 - RNA, 20 nt, Artificial Sequence
  Guide Sequence
gcagauagucgcuaaauuac

SEQ ID NO: 10502 - RNA, 20 nt, Artificial Sequence
  Guide Sequence
gcaggaccauucguugggga

SEQ ID NO: 10503 - RNA, 20 nt, Artificial Sequence
  Guide Sequence
gcaggcuaaugaaagcagau

SEQ ID NO: 10504 - RNA, 20 nt, Artificial Sequence
  Guide Sequence
gccaacuucuuuagugguua

SEQ ID NO: 10505 - RNA, 20 nt, Artificial Sequence
  Guide Sequence
gccagagaggucggggugag

SEQ ID NO: 10506 - RNA, 20 nt, Artificial Sequence
  Guide Sequence
gcccccucuccucacccacc

SEQ ID NO: 10507 - RNA, 20 nt, Artificial Sequence
  Guide Sequence
gccccgugcuguuugcuuuu

SEQ ID NO: 10508 - RNA, 20 nt, Artificial Sequence
  Guide Sequence
gcccugcacccugggugggc

SEQ ID NO: 10509 - RNA, 20 nt, Artificial Sequence
  Guide Sequence
gccucaaggcuacuccauca

SEQ ID NO: 10510 - RNA, 20 nt, Artificial Sequence
  Guide Sequence
gccucugauaggaggggccu

SEQ ID NO: 10511 - RNA, 20 nt, Artificial Sequence
  Guide Sequence
gccugaggggcugggcagac

SEQ ID NO: 10512 - RNA, 20 nt, Artificial Sequence
  Guide Sequence
gccugccucugauaggaggg

SEQ ID NO: 10513 - RNA, 20 nt, Artificial Sequence
  Guide Sequence
gccugggcuagucagccaga

SEQ ID NO: 10514 - RNA, 20 nt, Artificial Sequence
  Guide Sequence
gcuaaauuacccuccuggag

SEQ ID NO: 10515 - RNA, 20 nt, Artificial Sequence
  Guide Sequence
gcuaaugaaagcagauaguc

SEQ ID NO: 10516 - RNA, 20 nt, Artificial Sequence
  Guide Sequence
gcuaauucucacuguuuuau

SEQ ID NO: 10517 - RNA, 20 nt, Artificial Sequence
  Guide Sequence
gcuagcucuuccuugacaaa

SEQ ID NO: 10518 - RNA, 20 nt, Artificial Sequence
  Guide Sequence
gcuagucagccagagagguc

SEQ ID NO: 10519 - RNA, 20 nt, Artificial Sequence
  Guide Sequence
gcucuuccuugacaaacagc

SEQ ID NO: 10520 - RNA, 20 nt, Artificial Sequence
  Guide Sequence
gcugggcagacuaugcagga

SEQ ID NO: 10521 - RNA, 20 nt, Artificial Sequence
  Guide Sequence
gcuguuugcuuuucugcaga

SEQ ID NO: 10522 - RNA, 20 nt, Artificial Sequence
  Guide Sequence
gcuuuucugcagaauccccu

SEQ ID NO: 10523 - RNA, 20 nt, Artificial Sequence
  Guide Sequence
ggaaaaguuaacgagcaggc

SEQ ID NO: 10524 - RNA, 20 nt, Artificial Sequence
  Guide Sequence
ggaaacugaaaacacacacu

SEQ ID NO: 10525 - RNA, 20 nt, Artificial Sequence
  Guide Sequence
ggaauugaugaccgggccuc

SEQ ID NO: 10526 - RNA, 20 nt, Artificial Sequence
  Guide Sequence
ggaccauucguuggggaauu

SEQ ID NO: 10527 - RNA, 20 nt, Artificial Sequence
  Guide Sequence
ggagauuuaagggucuugau

SEQ ID NO: 10528 - RNA, 20 nt, Artificial Sequence
  Guide Sequence
ggagccugggcuagucagcc

SEQ ID NO: 10529 - RNA, 20 nt, Artificial Sequence
  Guide Sequence
ggaggggccugaggggcugg

SEQ ID NO: 10530 - RNA, 20 nt, Artificial Sequence
  Guide Sequence
ggcacucccaccaucuccag

SEQ ID NO: 10531 - RNA, 20 nt, Artificial Sequence
  Guide Sequence
ggcagacuaugcaggaccau

SEQ ID NO: 10532 - RNA, 20 nt, Artificial Sequence
  Guide Sequence
ggccaacuucuuuagugguu

SEQ ID NO: 10533 - RNA, 20 nt, Artificial Sequence
  Guide Sequence
ggccccgugcuguuugcuuu

SEQ ID NO: 10534 - RNA, 20 nt, Artificial Sequence
  Guide Sequence
ggccucaaggcuacuccauc

SEQ ID NO: 10535 - RNA, 20 nt, Artificial Sequence
  Guide Sequence
ggccugaggggcugggcaga

SEQ ID NO: 10536 - RNA, 20 nt, Artificial Sequence
  Guide Sequence
ggcuaaugaaagcagauagu

SEQ ID NO: 10537 - RNA, 20 nt, Artificial Sequence
  Guide Sequence
ggcuacuccaucaaugcagc

SEQ ID NO: 10538 - RNA, 20 nt, Artificial Sequence
  Guide Sequence
ggcuagcucuuccuugacaa

SEQ ID NO: 10539 - RNA, 20 nt, Artificial Sequence
  Guide Sequence
ggcuagucagccagagaggu

SEQ ID NO: 10540 - RNA, 20 nt, Artificial Sequence
  Guide Sequence
ggcugggcagacuaugcagg

SEQ ID NO: 10541 - RNA, 20 nt, Artificial Sequence
  Guide Sequence
gggaaaaguuaacgagcagg

SEQ ID NO: 10542 - RNA, 20 nt, Artificial Sequence
  Guide Sequence
gggaaacugaaaacacacac

SEQ ID NO: 10543 - RNA, 20 nt, Artificial Sequence
  Guide Sequence
gggaauugaugaccgggccu

SEQ ID NO: 10544 - RNA, 20 nt, Artificial Sequence
  Guide Sequence
gggagauuuaagggucuuga

SEQ ID NO: 10545 - RNA, 20 nt, Artificial Sequence
  Guide Sequence
gggcacucccaccaucucca

SEQ ID NO: 10546 - RNA, 20 nt, Artificial Sequence
  Guide Sequence
gggcagacuaugcaggacca

SEQ ID NO: 10547 - RNA, 20 nt, Artificial Sequence
  Guide Sequence
gggccaacuucuuuaguggu

SEQ ID NO: 10548 - RNA, 20 nt, Artificial Sequence
  Guide Sequence
gggccucaaggcuacuccau

SEQ ID NO: 10549 - RNA, 20 nt, Artificial Sequence
  Guide Sequence
gggccugaggggcugggcag

SEQ ID NO: 10550 - RNA, 20 nt, Artificial Sequence
  Guide Sequence
gggcuagucagccagagagg

SEQ ID NO: 10551 - RNA, 20 nt, Artificial Sequence
  Guide Sequence
gggcugggcagacuaugcag

SEQ ID NO: 10552 - RNA, 20 nt, Artificial Sequence
  Guide Sequence
ggggaauugaugaccgggcc

SEQ ID NO: 10553 - RNA, 20 nt, Artificial Sequence
  Guide Sequence
ggggccugaggggcugggca

SEQ ID NO: 10554 - RNA, 20 nt, Artificial Sequence
  Guide Sequence
ggggcugggcagacuaugca

SEQ ID NO: 10555 - RNA, 20 nt, Artificial Sequence
  Guide Sequence
ggggguagugugagagggag

SEQ ID NO: 10556 - RNA, 20 nt, Artificial Sequence
  Guide Sequence
gggguagugugagagggaga

SEQ ID NO: 10557 - RNA, 20 nt, Artificial Sequence
  Guide Sequence
ggggugaggccccgugcugu

SEQ ID NO: 10558 - RNA, 20 nt, Artificial Sequence
  Guide Sequence
ggguagugugagagggagau

SEQ ID NO: 10559 - RNA, 20 nt, Artificial Sequence
  Guide Sequence
gggucuugaucaaggucuca

SEQ ID NO: 10560 - RNA, 20 nt, Artificial Sequence
  Guide Sequence
gggugaggccccgugcuguu

SEQ ID NO: 10561 - RNA, 20 nt, Artificial Sequence
  Guide Sequence
gggugggcacucccaccauc

SEQ ID NO: 10562 - RNA, 20 nt, Artificial Sequence
  Guide Sequence
gguaaacaauuccuugugug

SEQ ID NO: 10563 - RNA, 20 nt, Artificial Sequence
  Guide Sequence
gguagugugagagggagauu

SEQ ID NO: 10564 - RNA, 20 nt, Artificial Sequence
  Guide Sequence
ggucggggugaggccccgug

SEQ ID NO: 10565 - RNA, 20 nt, Artificial Sequence
  Guide Sequence
ggucucagguaaacaauucc

SEQ ID NO: 10566 - RNA, 20 nt, Artificial Sequence
  Guide Sequence
ggucuugaucaaggucucag

SEQ ID NO: 10567 - RNA, 20 nt, Artificial Sequence
  Guide Sequence
ggugaggccccgugcuguuu

SEQ ID NO: 10568 - RNA, 20 nt, Artificial Sequence
  Guide Sequence
ggugggcacucccaccaucu

SEQ ID NO: 10569 - RNA, 20 nt, Artificial Sequence
  Guide Sequence
guaaacaauuccuugugugu

SEQ ID NO: 10570 - RNA, 20 nt, Artificial Sequence
  Guide Sequence
guaaacagcuaauucucacu

SEQ ID NO: 10571 - RNA, 20 nt, Artificial Sequence
  Guide Sequence
guagugugagagggagauuu

SEQ ID NO: 10572 - RNA, 20 nt, Artificial Sequence
  Guide Sequence
gucagccagagaggucgggg

SEQ ID NO: 10573 - RNA, 20 nt, Artificial Sequence
  Guide Sequence
gucgcuaaauuacccuccug

SEQ ID NO: 10574 - RNA, 20 nt, Artificial Sequence
  Guide Sequence
gucggggugaggccccgugc

SEQ ID NO: 10575 - RNA, 20 nt, Artificial Sequence
  Guide Sequence
gucucagguaaacaauuccu

SEQ ID NO: 10576 - RNA, 20 nt, Artificial Sequence
  Guide Sequence
gucuugaucaaggucucagg

SEQ ID NO: 10577 - RNA, 20 nt, Artificial Sequence
  Guide Sequence
gugagagggagauuuaaggg

SEQ ID NO: 10578 - RNA, 20 nt, Artificial Sequence
  Guide Sequence
gugaggccccgugcuguuug

SEQ ID NO: 10579 - RNA, 20 nt, Artificial Sequence
  Guide Sequence
gugcuguuugcuuuucugca

SEQ ID NO: 10580 - RNA, 20 nt, Artificial Sequence
  Guide Sequence
gugggcacucccaccaucuc

SEQ ID NO: 10581 - RNA, 20 nt, Artificial Sequence
  Guide Sequence
guguaaacagcuaauucuca

SEQ ID NO: 10582 - RNA, 20 nt, Artificial Sequence
  Guide Sequence
gugugagagggagauuuaag

SEQ ID NO: 10583 - RNA, 20 nt, Artificial Sequence
  Guide Sequence
guguguaaacagcuaauucu

SEQ ID NO: 10584 - RNA, 20 nt, Artificial Sequence
  Guide Sequence
guuaacgagcaggcuaauga

SEQ ID NO: 10585 - RNA, 20 nt, Artificial Sequence
  Guide Sequence
guuggggaauugaugaccgg

SEQ ID NO: 10586 - RNA, 20 nt, Artificial Sequence
  Guide Sequence
guuugcuuuucugcagaauc

SEQ ID NO: 10587 - RNA, 20 nt, Artificial Sequence
  Guide Sequence
guuuuauaagaagggaaacu

SEQ ID NO: 10588 - RNA, 20 nt, Artificial Sequence
  Guide Sequence
uaaacaauuccuugugugua

SEQ ID NO: 10589 - RNA, 20 nt, Artificial Sequence
  Guide Sequence
uaaacagcuaauucucacug

SEQ ID NO: 10590 - RNA, 20 nt, Artificial Sequence
  Guide Sequence
uaaauuacccuccuggagcc

SEQ ID NO: 10591 - RNA, 20 nt, Artificial Sequence
  Guide Sequence
uaacacccagaaacugacag

SEQ ID NO: 10592 - RNA, 20 nt, Artificial Sequence
  Guide Sequence
uaacgagcaggcuaaugaaa

SEQ ID NO: 10593 - RNA, 20 nt, Artificial Sequence
  Guide Sequence
uaagaagggaaacugaaaac

SEQ ID NO: 10594 - RNA, 20 nt, Artificial Sequence
  Guide Sequence
uaagggucuugaucaagguc

SEQ ID NO: 10595 - RNA, 20 nt, Artificial Sequence
  Guide Sequence
uaaugaaagcagauagucgc

SEQ ID NO: 10596 - RNA, 20 nt, Artificial Sequence
  Guide Sequence
uacccuccuggagccugggc

SEQ ID NO: 10597 - RNA, 20 nt, Artificial Sequence
  Guide Sequence
uagcucuuccuugacaaaca

SEQ ID NO: 10598 - RNA, 20 nt, Artificial Sequence
  Guide Sequence
uaggaggggccugaggggcu

SEQ ID NO: 10599 - RNA, 20 nt, Artificial Sequence
  Guide Sequence
uagucagccagagaggucgg

SEQ ID NO: 10600 - RNA, 20 nt, Artificial Sequence
  Guide Sequence
uagucgcuaaauuacccucc

SEQ ID NO: 10601 - RNA, 20 nt, Artificial Sequence
  Guide Sequence
uagugugagagggagauuua

SEQ ID NO: 10602 - RNA, 20 nt, Artificial Sequence
  Guide Sequence
uauaagaagggaaacugaaa

SEQ ID NO: 10603 - RNA, 20 nt, Artificial Sequence
  Guide Sequence
uaugcaggaccauucguugg

SEQ ID NO: 10604 - RNA, 20 nt, Artificial Sequence
  Guide Sequence
ucaaggcuacuccaucaaug

SEQ ID NO: 10605 - RNA, 20 nt, Artificial Sequence
  Guide Sequence
ucaaggucucagguaaacaa

SEQ ID NO: 10606 - RNA, 20 nt, Artificial Sequence
  Guide Sequence
ucacuguuuuauaagaaggg

SEQ ID NO: 10607 - RNA, 20 nt, Artificial Sequence
  Guide Sequence
ucagccagagaggucggggu

SEQ ID NO: 10608 - RNA, 20 nt, Artificial Sequence
  Guide Sequence
ucagguaaacaauuccuugu

SEQ ID NO: 10609 - RNA, 20 nt, Artificial Sequence
  Guide Sequence
uccagggccaacuucuuuag

SEQ ID NO: 10610 - RNA, 20 nt, Artificial Sequence
  Guide Sequence
ucccaccaucuccagggcca

SEQ ID NO: 10611 - RNA, 20 nt, Artificial Sequence
  Guide Sequence
uccccuccugccugccucug

SEQ ID NO: 10612 - RNA, 20 nt, Artificial Sequence
  Guide Sequence
uccugccugccucugauagg

SEQ ID NO: 10613 - RNA, 20 nt, Artificial Sequence
  Guide Sequence
uccuggagccugggcuaguc

SEQ ID NO: 10614 - RNA, 20 nt, Artificial Sequence
  Guide Sequence
uccuugacaaacagcccugc

SEQ ID NO: 10615 - RNA, 20 nt, Artificial Sequence
  Guide Sequence
uccuuguguguaaacagcua

SEQ ID NO: 10616 - RNA, 20 nt, Artificial Sequence
  Guide Sequence
ucgcuaaauuacccuccugg

SEQ ID NO: 10617 - RNA, 20 nt, Artificial Sequence
  Guide Sequence
ucggggugaggccccgugcu

SEQ ID NO: 10618 - RNA, 20 nt, Artificial Sequence
  Guide Sequence
ucguuggggaauugaugacc

SEQ ID NO: 10619 - RNA, 20 nt, Artificial Sequence
  Guide Sequence
ucucacuguuuuauaagaag

SEQ ID NO: 10620 - RNA, 20 nt, Artificial Sequence
  Guide Sequence
ucucagguaaacaauuccuu

SEQ ID NO: 10621 - RNA, 20 nt, Artificial Sequence
  Guide Sequence
ucuccagggccaacuucuuu

SEQ ID NO: 10622 - RNA, 20 nt, Artificial Sequence
  Guide Sequence
ucugauaggaggggccugag

SEQ ID NO: 10623 - RNA, 20 nt, Artificial Sequence
  Guide Sequence
ucugcagaauccccuccugc

SEQ ID NO: 10624 - RNA, 20 nt, Artificial Sequence
  Guide Sequence
ucuuccuugacaaacagccc

SEQ ID NO: 10625 - RNA, 20 nt, Artificial Sequence
  Guide Sequence
ucuugaucaaggucucaggu

SEQ ID NO: 10626 - RNA, 20 nt, Artificial Sequence
  Guide Sequence
ugaaaacacacacuaacacc

SEQ ID NO: 10627 - RNA, 20 nt, Artificial Sequence
  Guide Sequence
ugaaagcagauagucgcuaa

SEQ ID NO: 10628 - RNA, 20 nt, Artificial Sequence
  Guide Sequence
ugacaaacagcccugcaccc

SEQ ID NO: 10629 - RNA, 20 nt, Artificial Sequence
  Guide Sequence
ugacagcccccucuccucac

SEQ ID NO: 10630 - RNA, 20 nt, Artificial Sequence
  Guide Sequence
ugaccgggccucaaggcuac

SEQ ID NO: 10631 - RNA, 20 nt, Artificial Sequence
  Guide Sequence
ugagagggagauuuaagggu

SEQ ID NO: 10632 - RNA, 20 nt, Artificial Sequence
  Guide Sequence
ugaggccccgugcuguuugc

SEQ ID NO: 10633 - RNA, 20 nt, Artificial Sequence
  Guide Sequence
ugaggggcugggcagacuau

SEQ ID NO: 10634 - RNA, 20 nt, Artificial Sequence
  Guide Sequence
ugauaggaggggccugaggg

SEQ ID NO: 10635 - RNA, 20 nt, Artificial Sequence
  Guide Sequence
ugaucaaggucucagguaaa

SEQ ID NO: 10636 - RNA, 20 nt, Artificial Sequence
  Guide Sequence
ugaugaccgggccucaaggc

SEQ ID NO: 10637 - RNA, 20 nt, Artificial Sequence
  Guide Sequence
ugcacccugggugggcacuc

SEQ ID NO: 10638 - RNA, 20 nt, Artificial Sequence
  Guide Sequence
ugcagaauccccuccugccu

SEQ ID NO: 10639 - RNA, 20 nt, Artificial Sequence
  Guide Sequence
ugcaggaccauucguugggg

SEQ ID NO: 10640 - RNA, 20 nt, Artificial Sequence
  Guide Sequence
ugccucugauaggaggggcc

SEQ ID NO: 10641 - RNA, 20 nt, Artificial Sequence
  Guide Sequence
ugccugccucugauaggagg

SEQ ID NO: 10642 - RNA, 20 nt, Artificial Sequence
  Guide Sequence
ugcuguuugcuuuucugcag

SEQ ID NO: 10643 - RNA, 20 nt, Artificial Sequence
  Guide Sequence
ugcuuuucugcagaaucccc

SEQ ID NO: 10644 - RNA, 20 nt, Artificial Sequence
  Guide Sequence
uggagccugggcuagucagc

SEQ ID NO: 10645 - RNA, 20 nt, Artificial Sequence
  Guide Sequence
ugggaaaaguuaacgagcag

SEQ ID NO: 10646 - RNA, 20 nt, Artificial Sequence
  Guide Sequence
ugggcacucccaccaucucc

SEQ ID NO: 10647 - RNA, 20 nt, Artificial Sequence
  Guide Sequence
ugggcagacuaugcaggacc

SEQ ID NO: 10648 - RNA, 20 nt, Artificial Sequence
  Guide Sequence
ugggcuagucagccagagag

SEQ ID NO: 10649 - RNA, 20 nt, Artificial Sequence
  Guide Sequence
uggggaauugaugaccgggc

SEQ ID NO: 10650 - RNA, 20 nt, Artificial Sequence
  Guide Sequence
uggggguagugugagaggga

SEQ ID NO: 10651 - RNA, 20 nt, Artificial Sequence
  Guide Sequence
ugggugggcacucccaccau

SEQ ID NO: 10652 - RNA, 20 nt, Artificial Sequence
  Guide Sequence
uguaaacagcuaauucucac

SEQ ID NO: 10653 - RNA, 20 nt, Artificial Sequence
  Guide Sequence
ugugagagggagauuuaagg

SEQ ID NO: 10654 - RNA, 20 nt, Artificial Sequence
  Guide Sequence
uguguaaacagcuaauucuc

SEQ ID NO: 10655 - RNA, 20 nt, Artificial Sequence
  Guide Sequence
uguguguaaacagcuaauuc

SEQ ID NO: 10656 - RNA, 20 nt, Artificial Sequence
  Guide Sequence
uguuugcuuuucugcagaau

SEQ ID NO: 10657 - RNA, 20 nt, Artificial Sequence
  Guide Sequence
uguuuuauaagaagggaaac

SEQ ID NO: 10658 - RNA, 20 nt, Artificial Sequence
  Guide Sequence
uuaacgagcaggcuaaugaa

SEQ ID NO: 10659 - RNA, 20 nt, Artificial Sequence
  Guide Sequence
uuaagggucuugaucaaggu

SEQ ID NO: 10660 - RNA, 20 nt, Artificial Sequence
  Guide Sequence
uuacccuccuggagccuggg

SEQ ID NO: 10661 - RNA, 20 nt, Artificial Sequence
  Guide Sequence
uuauaagaagggaaacugaa

SEQ ID NO: 10662 - RNA, 20 nt, Artificial Sequence
  Guide Sequence
uuccuugacaaacagcccug

SEQ ID NO: 10663 - RNA, 20 nt, Artificial Sequence
  Guide Sequence
uuccuuguguguaaacagcu

SEQ ID NO: 10664 - RNA, 20 nt, Artificial Sequence
  Guide Sequence
uucguuggggaauugaugac

SEQ ID NO: 10665 - RNA, 20 nt, Artificial Sequence
  Guide Sequence
uucugcagaauccccuccug

SEQ ID NO: 10666 - RNA, 20 nt, Artificial Sequence
  Guide Sequence
uugacaaacagcccugcacc

SEQ ID NO: 10667 - RNA, 20 nt, Artificial Sequence
  Guide Sequence
uugaucaaggucucagguaa

SEQ ID NO: 10668 - RNA, 20 nt, Artificial Sequence
  Guide Sequence
uugaugaccgggccucaagg

SEQ ID NO: 10669 - RNA, 20 nt, Artificial Sequence
  Guide Sequence
uugcuuuucugcagaauccc

SEQ ID NO: 10670 - RNA, 20 nt, Artificial Sequence
  Guide Sequence
uuggggaauugaugaccggg

SEQ ID NO: 10671 - RNA, 20 nt, Artificial Sequence
  Guide Sequence
uuguguguaaacagcuaauu

SEQ ID NO: 10672 - RNA, 20 nt, Artificial Sequence
  Guide Sequence
uuuaagggucuugaucaagg

SEQ ID NO: 10673 - RNA, 20 nt, Artificial Sequence
  Guide Sequence
uuuauaagaagggaaacuga

SEQ ID NO: 10674 - RNA, 20 nt, Artificial Sequence
  Guide Sequence
uuucugcagaauccccuccu

SEQ ID NO: 10675 - RNA, 20 nt, Artificial Sequence
  Guide Sequence
uuugcuuuucugcagaaucc

SEQ ID NO: 10676 - RNA, 20 nt, Artificial Sequence
  Guide Sequence
uuuuauaagaagggaaacug

SEQ ID NO: 10677 - RNA, 20 nt, Artificial Sequence
  Guide Sequence
uuuucugcagaauccccucc

SEQ ID NO: 10678 - RNA, 21 nt, Artificial Sequence
  Guide Sequence
aaaacacacacuaacacccag

SEQ ID NO: 10679 - RNA, 21 nt, Artificial Sequence
  Guide Sequence
aaaaguuaacgagcaggcuaa

SEQ ID NO: 10680 - RNA, 21 nt, Artificial Sequence
  Guide Sequence
aaacacacacuaacacccaga

SEQ ID NO: 10681 - RNA, 21 nt, Artificial Sequence
  Guide Sequence
aaacagcccugcacccugggu

SEQ ID NO: 10682 - RNA, 21 nt, Artificial Sequence
  Guide Sequence
aaacagcuaauucucacuguu

SEQ ID NO: 10683 - RNA, 21 nt, Artificial Sequence
  Guide Sequence
aaacugaaaacacacacuaac

SEQ ID NO: 10684 - RNA, 21 nt, Artificial Sequence
  Guide Sequence
aaacugacagcccccucuccu

SEQ ID NO: 10685 - RNA, 21 nt, Artificial Sequence
  Guide Sequence
aaagcagauagucgcuaaauu

SEQ ID NO: 10686 - RNA, 21 nt, Artificial Sequence
  Guide Sequence
aaaguuaacgagcaggcuaau

SEQ ID NO: 10687 - RNA, 21 nt, Artificial Sequence
  Guide Sequence
aaauuacccuccuggagccug

SEQ ID NO: 10688 - RNA, 21 nt, Artificial Sequence
  Guide Sequence
aacaauuccuuguguguaaac

SEQ ID NO: 10689 - RNA, 21 nt, Artificial Sequence
  Guide Sequence
aacacacacuaacacccagaa

SEQ ID NO: 10690 - RNA, 21 nt, Artificial Sequence
  Guide Sequence
aacacccagaaacugacagcc

SEQ ID NO: 10691 - RNA, 21 nt, Artificial Sequence
  Guide Sequence
aacagcccugcacccugggug

SEQ ID NO: 10692 - RNA, 21 nt, Artificial Sequence
  Guide Sequence
aacagcuaauucucacuguuu

SEQ ID NO: 10693 - RNA, 21 nt, Artificial Sequence
  Guide Sequence
aacgagcaggcuaaugaaagc

SEQ ID NO: 10694 - RNA, 21 nt, Artificial Sequence
  Guide Sequence
aacugaaaacacacacuaaca

SEQ ID NO: 10695 - RNA, 21 nt, Artificial Sequence
  Guide Sequence
aacugacagcccccucuccuc

SEQ ID NO: 10696 - RNA, 21 nt, Artificial Sequence
  Guide Sequence
aagaagggaaacugaaaacac

SEQ ID NO: 10697 - RNA, 21 nt, Artificial Sequence
  Guide Sequence
aagcagauagucgcuaaauua

SEQ ID NO: 10698 - RNA, 21 nt, Artificial Sequence
  Guide Sequence
aaggcuacuccaucaaugcag

SEQ ID NO: 10699 - RNA, 21 nt, Artificial Sequence
  Guide Sequence
aagggaaacugaaaacacaca

SEQ ID NO: 10700 - RNA, 21 nt, Artificial Sequence
  Guide Sequence
aagggucuugaucaaggucuc

SEQ ID NO: 10701 - RNA, 21 nt, Artificial Sequence
  Guide Sequence
aaggucucagguaaacaauuc

SEQ ID NO: 10702 - RNA, 21 nt, Artificial Sequence
  Guide Sequence
aaguuaacgagcaggcuaaug

SEQ ID NO: 10703 - RNA, 21 nt, Artificial Sequence
  Guide Sequence
aauccccuccugccugccucu

SEQ ID NO: 10704 - RNA, 21 nt, Artificial Sequence
  Guide Sequence
aaugaaagcagauagucgcua

SEQ ID NO: 10705 - RNA, 21 nt, Artificial Sequence
  Guide Sequence
aauuacccuccuggagccugg

SEQ ID NO: 10706 - RNA, 21 nt, Artificial Sequence
  Guide Sequence
aauuccuuguguguaaacagc

SEQ ID NO: 10707 - RNA, 21 nt, Artificial Sequence
  Guide Sequence
aauugaugaccgggccucaag

SEQ ID NO: 10708 - RNA, 21 nt, Artificial Sequence
  Guide Sequence
acaaacagcccugcacccugg

SEQ ID NO: 10709 - RNA, 21 nt, Artificial Sequence
  Guide Sequence
acaauuccuuguguguaaaca

SEQ ID NO: 10710 - RNA, 21 nt, Artificial Sequence
  Guide Sequence
acacacacuaacacccagaaa

SEQ ID NO: 10711 - RNA, 21 nt, Artificial Sequence
  Guide Sequence
acacacuaacacccagaaacu

SEQ ID NO: 10712 - RNA, 21 nt, Artificial Sequence
  Guide Sequence
acacccagaaacugacagccc

SEQ ID NO: 10713 - RNA, 21 nt, Artificial Sequence
  Guide Sequence
acacuaacacccagaaacuga

SEQ ID NO: 10714 - RNA, 21 nt, Artificial Sequence
  Guide Sequence
acagcccccucuccucaccca

SEQ ID NO: 10715 - RNA, 21 nt, Artificial Sequence
  Guide Sequence
acagcccugcacccugggugg

SEQ ID NO: 10716 - RNA, 21 nt, Artificial Sequence
  Guide Sequence
acagcuaauucucacuguuuu

SEQ ID NO: 10717 - RNA, 21 nt, Artificial Sequence
  Guide Sequence
accaucuccagggccaacuuc

SEQ ID NO: 10718 - RNA, 21 nt, Artificial Sequence
  Guide Sequence
accauucguuggggaauugau

SEQ ID NO: 10719 - RNA, 21 nt, Artificial Sequence
  Guide Sequence
acccagaaacugacagccccc

SEQ ID NO: 10720 - RNA, 21 nt, Artificial Sequence
  Guide Sequence
acccuccuggagccugggcua

SEQ ID NO: 10721 - RNA, 21 nt, Artificial Sequence
  Guide Sequence
acccugggugggcacucccac

SEQ ID NO: 10722 - RNA, 21 nt, Artificial Sequence
  Guide Sequence
accgggccucaaggcuacucc

SEQ ID NO: 10723 - RNA, 21 nt, Artificial Sequence
  Guide Sequence
acgagcaggcuaaugaaagca

SEQ ID NO: 10724 - RNA, 21 nt, Artificial Sequence
  Guide Sequence
acuaacacccagaaacugaca

SEQ ID NO: 10725 - RNA, 21 nt, Artificial Sequence
  Guide Sequence
acuaugcaggaccauucguug

SEQ ID NO: 10726 - RNA, 21 nt, Artificial Sequence
  Guide Sequence
acucccaccaucuccagggcc

SEQ ID NO: 10727 - RNA, 21 nt, Artificial Sequence
  Guide Sequence
acugaaaacacacacuaacac

SEQ ID NO: 10728 - RNA, 21 nt, Artificial Sequence
  Guide Sequence
acugacagcccccucuccuca

SEQ ID NO: 10729 - RNA, 21 nt, Artificial Sequence
  Guide Sequence
agaaacugacagcccccucuc

SEQ ID NO: 10730 - RNA, 21 nt, Artificial Sequence
  Guide Sequence
agaagggaaacugaaaacaca

SEQ ID NO: 10731 - RNA, 21 nt, Artificial Sequence
  Guide Sequence
agaauccccuccugccugccu

SEQ ID NO: 10732 - RNA, 21 nt, Artificial Sequence
  Guide Sequence
agacuaugcaggaccauucgu

SEQ ID NO: 10733 - RNA, 21 nt, Artificial Sequence
  Guide Sequence
agagaggucggggugaggccc

SEQ ID NO: 10734 - RNA, 21 nt, Artificial Sequence
  Guide Sequence
agagggagauuuaagggucuu

SEQ ID NO: 10735 - RNA, 21 nt, Artificial Sequence
  Guide Sequence
agaggucggggugaggccccg

SEQ ID NO: 10736 - RNA, 21 nt, Artificial Sequence
  Guide Sequence
agauagucgcuaaauuacccu

SEQ ID NO: 10737 - RNA, 21 nt, Artificial Sequence
  Guide Sequence
agauuuaagggucuugaucaa

SEQ ID NO: 10738 - RNA, 21 nt, Artificial Sequence
  Guide Sequence
agcagauagucgcuaaauuac

SEQ ID NO: 10739 - RNA, 21 nt, Artificial Sequence
  Guide Sequence
agcaggcuaaugaaagcagau

SEQ ID NO: 10740 - RNA, 21 nt, Artificial Sequence
  Guide Sequence
agccagagaggucggggugag

SEQ ID NO: 10741 - RNA, 21 nt, Artificial Sequence
  Guide Sequence
agcccccucuccucacccacc

SEQ ID NO: 10742 - RNA, 21 nt, Artificial Sequence
  Guide Sequence
agcccugcacccugggugggc

SEQ ID NO: 10743 - RNA, 21 nt, Artificial Sequence
  Guide Sequence
agccugggcuagucagccaga

SEQ ID NO: 10744 - RNA, 21 nt, Artificial Sequence
  Guide Sequence
agcucuuccuugacaaacagc

SEQ ID NO: 10745 - RNA, 21 nt, Artificial Sequence
  Guide Sequence
aggaccauucguuggggaauu

SEQ ID NO: 10746 - RNA, 21 nt, Artificial Sequence
  Guide Sequence
aggaggggccugaggggcugg

SEQ ID NO: 10747 - RNA, 21 nt, Artificial Sequence
  Guide Sequence
aggccccgugcuguuugcuuu

SEQ ID NO: 10748 - RNA, 21 nt, Artificial Sequence
  Guide Sequence
aggcuaaugaaagcagauagu

SEQ ID NO: 10749 - RNA, 21 nt, Artificial Sequence
  Guide Sequence
aggcuacuccaucaaugcagc

SEQ ID NO: 10750 - RNA, 21 nt, Artificial Sequence
  Guide Sequence
agggaaacugaaaacacacac

SEQ ID NO: 10751 - RNA, 21 nt, Artificial Sequence
  Guide Sequence
agggagauuuaagggucuuga

SEQ ID NO: 10752 - RNA, 21 nt, Artificial Sequence
  Guide Sequence
agggccaacuucuuuaguggu

SEQ ID NO: 10753 - RNA, 21 nt, Artificial Sequence
  Guide Sequence
aggggccugaggggcugggca

SEQ ID NO: 10754 - RNA, 21 nt, Artificial Sequence
  Guide Sequence
aggggcugggcagacuaugca

SEQ ID NO: 10755 - RNA, 21 nt, Artificial Sequence
  Guide Sequence
agggucuugaucaaggucuca

SEQ ID NO: 10756 - RNA, 21 nt, Artificial Sequence
  Guide Sequence
agguaaacaauuccuugugug

SEQ ID NO: 10757 - RNA, 21 nt, Artificial Sequence
  Guide Sequence
aggucggggugaggccccgug

SEQ ID NO: 10758 - RNA, 21 nt, Artificial Sequence
  Guide Sequence
aggucucagguaaacaauucc

SEQ ID NO: 10759 - RNA, 21 nt, Artificial Sequence
  Guide Sequence
agucagccagagaggucgggg

SEQ ID NO: 10760 - RNA, 21 nt, Artificial Sequence
  Guide Sequence
agucgcuaaauuacccuccug

SEQ ID NO: 10761 - RNA, 21 nt, Artificial Sequence
  Guide Sequence
agugugagagggagauuuaag

SEQ ID NO: 10762 - RNA, 21 nt, Artificial Sequence
  Guide Sequence
aguuaacgagcaggcuaauga

SEQ ID NO: 10763 - RNA, 21 nt, Artificial Sequence
  Guide Sequence
auaagaagggaaacugaaaac

SEQ ID NO: 10764 - RNA, 21 nt, Artificial Sequence
  Guide Sequence
auaggaggggccugaggggcu

SEQ ID NO: 10765 - RNA, 21 nt, Artificial Sequence
  Guide Sequence
auagucgcuaaauuacccucc

SEQ ID NO: 10766 - RNA, 21 nt, Artificial Sequence
  Guide Sequence
aucaaggucucagguaaacaa

SEQ ID NO: 10767 - RNA, 21 nt, Artificial Sequence
  Guide Sequence
auccccuccugccugccucug

SEQ ID NO: 10768 - RNA, 21 nt, Artificial Sequence
  Guide Sequence
aucuccagggccaacuucuuu

SEQ ID NO: 10769 - RNA, 21 nt, Artificial Sequence
  Guide Sequence
augaaagcagauagucgcuaa

SEQ ID NO: 10770 - RNA, 21 nt, Artificial Sequence
  Guide Sequence
augaccgggccucaaggcuac

SEQ ID NO: 10771 - RNA, 21 nt, Artificial Sequence
  Guide Sequence
augcaggaccauucguugggg

SEQ ID NO: 10772 - RNA, 21 nt, Artificial Sequence
  Guide Sequence
auuacccuccuggagccuggg

SEQ ID NO: 10773 - RNA, 21 nt, Artificial Sequence
  Guide Sequence
auuccuuguguguaaacagcu

SEQ ID NO: 10774 - RNA, 21 nt, Artificial Sequence
  Guide Sequence
auucguuggggaauugaugac

SEQ ID NO: 10775 - RNA, 21 nt, Artificial Sequence
  Guide Sequence
auugaugaccgggccucaagg

SEQ ID NO: 10776 - RNA, 21 nt, Artificial Sequence
  Guide Sequence
auuuaagggucuugaucaagg

SEQ ID NO: 10777 - RNA, 21 nt, Artificial Sequence
  Guide Sequence
caaacagcccugcacccuggg

SEQ ID NO: 10778 - RNA, 21 nt, Artificial Sequence
  Guide Sequence
caaggcuacuccaucaaugca

SEQ ID NO: 10779 - RNA, 21 nt, Artificial Sequence
  Guide Sequence
caaggucucagguaaacaauu

SEQ ID NO: 10780 - RNA, 21 nt, Artificial Sequence
  Guide Sequence
caauuccuuguguguaaacag

SEQ ID NO: 10781 - RNA, 21 nt, Artificial Sequence
  Guide Sequence
cacacacuaacacccagaaac

SEQ ID NO: 10782 - RNA, 21 nt, Artificial Sequence
  Guide Sequence
cacacuaacacccagaaacug

SEQ ID NO: 10783 - RNA, 21 nt, Artificial Sequence
  Guide Sequence
caccaucuccagggccaacuu

SEQ ID NO: 10784 - RNA, 21 nt, Artificial Sequence
  Guide Sequence
cacccagaaacugacagcccc

SEQ ID NO: 10785 - RNA, 21 nt, Artificial Sequence
  Guide Sequence
cacccugggugggcacuccca

SEQ ID NO: 10786 - RNA, 21 nt, Artificial Sequence
  Guide Sequence
cacuaacacccagaaacugac

SEQ ID NO: 10787 - RNA, 21 nt, Artificial Sequence
  Guide Sequence
cacucccaccaucuccagggc

SEQ ID NO: 10788 - RNA, 21 nt, Artificial Sequence
  Guide Sequence
cacuguuuuauaagaagggaa

SEQ ID NO: 10789 - RNA, 21 nt, Artificial Sequence
  Guide Sequence
cagaaacugacagcccccucu

SEQ ID NO: 10790 - RNA, 21 nt, Artificial Sequence
  Guide Sequence
cagaauccccuccugccugcc

SEQ ID NO: 10791 - RNA, 21 nt, Artificial Sequence
  Guide Sequence
cagacuaugcaggaccauucg

SEQ ID NO: 10792 - RNA, 21 nt, Artificial Sequence
  Guide Sequence
cagagaggucggggugaggcc

SEQ ID NO: 10793 - RNA, 21 nt, Artificial Sequence
  Guide Sequence
cagauagucgcuaaauuaccc

SEQ ID NO: 10794 - RNA, 21 nt, Artificial Sequence
  Guide Sequence
cagccagagaggucgggguga

SEQ ID NO: 10795 - RNA, 21 nt, Artificial Sequence
  Guide Sequence
cagcccccucuccucacccac

SEQ ID NO: 10796 - RNA, 21 nt, Artificial Sequence
  Guide Sequence
cagcccugcacccuggguggg

SEQ ID NO: 10797 - RNA, 21 nt, Artificial Sequence
  Guide Sequence
cagcuaauucucacuguuuua

SEQ ID NO: 10798 - RNA, 21 nt, Artificial Sequence
  Guide Sequence
caggaccauucguuggggaau

SEQ ID NO: 10799 - RNA, 21 nt, Artificial Sequence
  Guide Sequence
caggcuaaugaaagcagauag

SEQ ID NO: 10800 - RNA, 21 nt, Artificial Sequence
  Guide Sequence
cagggccaacuucuuuagugg

SEQ ID NO: 10801 - RNA, 21 nt, Artificial Sequence
  Guide Sequence
cagguaaacaauuccuugugu

SEQ ID NO: 10802 - RNA, 21 nt, Artificial Sequence
  Guide Sequence
caucuccagggccaacuucuu

SEQ ID NO: 10803 - RNA, 21 nt, Artificial Sequence
  Guide Sequence
cauucguuggggaauugauga

SEQ ID NO: 10804 - RNA, 21 nt, Artificial Sequence
  Guide Sequence
ccaacuucuuuagugguuacu

SEQ ID NO: 10805 - RNA, 21 nt, Artificial Sequence
  Guide Sequence
ccaccaucuccagggccaacu

SEQ ID NO: 10806 - RNA, 21 nt, Artificial Sequence
  Guide Sequence
ccagaaacugacagcccccuc

SEQ ID NO: 10807 - RNA, 21 nt, Artificial Sequence
  Guide Sequence
ccagagaggucggggugaggc

SEQ ID NO: 10808 - RNA, 21 nt, Artificial Sequence
  Guide Sequence
ccagggccaacuucuuuagug

SEQ ID NO: 10809 - RNA, 21 nt, Artificial Sequence
  Guide Sequence
ccaucuccagggccaacuucu

SEQ ID NO: 10810 - RNA, 21 nt, Artificial Sequence
  Guide Sequence
ccauucguuggggaauugaug

SEQ ID NO: 10811 - RNA, 21 nt, Artificial Sequence
  Guide Sequence
cccaccaucuccagggccaac

SEQ ID NO: 10812 - RNA, 21 nt, Artificial Sequence
  Guide Sequence
cccagaaacugacagcccccu

SEQ ID NO: 10813 - RNA, 21 nt, Artificial Sequence
  Guide Sequence
ccccccggcuagcucuuccuu

SEQ ID NO: 10814 - RNA, 21 nt, Artificial Sequence
  Guide Sequence
cccccggcuagcucuuccuug

SEQ ID NO: 10815 - RNA, 21 nt, Artificial Sequence
  Guide Sequence
cccccucuccucacccacccc

SEQ ID NO: 10816 - RNA, 21 nt, Artificial Sequence
  Guide Sequence
ccccggcuagcucuuccuuga

SEQ ID NO: 10817 - RNA, 21 nt, Artificial Sequence
  Guide Sequence
ccccgugcuguuugcuuuucu

SEQ ID NO: 10818 - RNA, 21 nt, Artificial Sequence
  Guide Sequence
ccccuccugccugccucugau

SEQ ID NO: 10819 - RNA, 21 nt, Artificial Sequence
  Guide Sequence
ccccucuccucacccaccccc

SEQ ID NO: 10820 - RNA, 21 nt, Artificial Sequence
  Guide Sequence
cccggcuagcucuuccuugac

SEQ ID NO: 10821 - RNA, 21 nt, Artificial Sequence
  Guide Sequence
cccgugcuguuugcuuuucug

SEQ ID NO: 10822 - RNA, 21 nt, Artificial Sequence
  Guide Sequence
cccuccugccugccucugaua

SEQ ID NO: 10823 - RNA, 21 nt, Artificial Sequence
  Guide Sequence
cccuccuggagccugggcuag

SEQ ID NO: 10824 - RNA, 21 nt, Artificial Sequence
  Guide Sequence
cccucuccucacccacccccc

SEQ ID NO: 10825 - RNA, 21 nt, Artificial Sequence
  Guide Sequence
cccugcacccugggugggcac

SEQ ID NO: 10826 - RNA, 21 nt, Artificial Sequence
  Guide Sequence
cccugggugggcacucccacc

SEQ ID NO: 10827 - RNA, 21 nt, Artificial Sequence
  Guide Sequence
ccggcuagcucuuccuugaca

SEQ ID NO: 10828 - RNA, 21 nt, Artificial Sequence
  Guide Sequence
ccgggccucaaggcuacucca

SEQ ID NO: 10829 - RNA, 21 nt, Artificial Sequence
  Guide Sequence
ccgugcuguuugcuuuucugc

SEQ ID NO: 10830 - RNA, 21 nt, Artificial Sequence
  Guide Sequence
ccucaaggcuacuccaucaau

SEQ ID NO: 10831 - RNA, 21 nt, Artificial Sequence
  Guide Sequence
ccuccugccugccucugauag

SEQ ID NO: 10832 - RNA, 21 nt, Artificial Sequence
  Guide Sequence
ccuccuggagccugggcuagu

SEQ ID NO: 10833 - RNA, 21 nt, Artificial Sequence
  Guide Sequence
ccucugauaggaggggccuga

SEQ ID NO: 10834 - RNA, 21 nt, Artificial Sequence
  Guide Sequence
ccugaggggcugggcagacua

SEQ ID NO: 10835 - RNA, 21 nt, Artificial Sequence
  Guide Sequence
ccugcacccugggugggcacu

SEQ ID NO: 10836 - RNA, 21 nt, Artificial Sequence
  Guide Sequence
ccugccucugauaggaggggc

SEQ ID NO: 10837 - RNA, 21 nt, Artificial Sequence
  Guide Sequence
ccugccugccucugauaggag

SEQ ID NO: 10838 - RNA, 21 nt, Artificial Sequence
  Guide Sequence
ccuggagccugggcuagucag

SEQ ID NO: 10839 - RNA, 21 nt, Artificial Sequence
  Guide Sequence
ccugggcuagucagccagaga

SEQ ID NO: 10840 - RNA, 21 nt, Artificial Sequence
  Guide Sequence
ccugggugggcacucccacca

SEQ ID NO: 10841 - RNA, 21 nt, Artificial Sequence
  Guide Sequence
ccuugacaaacagcccugcac

SEQ ID NO: 10842 - RNA, 21 nt, Artificial Sequence
  Guide Sequence
ccuuguguguaaacagcuaau

SEQ ID NO: 10843 - RNA, 21 nt, Artificial Sequence
  Guide Sequence
cgagcaggcuaaugaaagcag

SEQ ID NO: 10844 - RNA, 21 nt, Artificial Sequence
  Guide Sequence
cgcuaaauuacccuccuggag

SEQ ID NO: 10845 - RNA, 21 nt, Artificial Sequence
  Guide Sequence
cggcuagcucuuccuugacaa

SEQ ID NO: 10846 - RNA, 21 nt, Artificial Sequence
  Guide Sequence
cgggccucaaggcuacuccau

SEQ ID NO: 10847 - RNA, 21 nt, Artificial Sequence
  Guide Sequence
cggggugaggccccgugcugu

SEQ ID NO: 10848 - RNA, 21 nt, Artificial Sequence
  Guide Sequence
cgugcuguuugcuuuucugca

SEQ ID NO: 10849 - RNA, 21 nt, Artificial Sequence
  Guide Sequence
cguuggggaauugaugaccgg

SEQ ID NO: 10850 - RNA, 21 nt, Artificial Sequence
  Guide Sequence
cuaaauuacccuccuggagcc

SEQ ID NO: 10851 - RNA, 21 nt, Artificial Sequence
  Guide Sequence
cuaacacccagaaacugacag

SEQ ID NO: 10852 - RNA, 21 nt, Artificial Sequence
  Guide Sequence
cuaaugaaagcagauagucgc

SEQ ID NO: 10853 - RNA, 21 nt, Artificial Sequence
  Guide Sequence
cuagcucuuccuugacaaaca

SEQ ID NO: 10854 - RNA, 21 nt, Artificial Sequence
  Guide Sequence
cuagucagccagagaggucgg

SEQ ID NO: 10855 - RNA, 21 nt, Artificial Sequence
  Guide Sequence
cuaugcaggaccauucguugg

SEQ ID NO: 10856 - RNA, 21 nt, Artificial Sequence
  Guide Sequence
cucaaggcuacuccaucaaug

SEQ ID NO: 10857 - RNA, 21 nt, Artificial Sequence
  Guide Sequence
cucacuguuuuauaagaaggg

SEQ ID NO: 10858 - RNA, 21 nt, Artificial Sequence
  Guide Sequence
cucagguaaacaauuccuugu

SEQ ID NO: 10859 - RNA, 21 nt, Artificial Sequence
  Guide Sequence
cuccagggccaacuucuuuag

SEQ ID NO: 10860 - RNA, 21 nt, Artificial Sequence
  Guide Sequence
cucccaccaucuccagggcca

SEQ ID NO: 10861 - RNA, 21 nt, Artificial Sequence
  Guide Sequence
cuccugccugccucugauagg

SEQ ID NO: 10862 - RNA, 21 nt, Artificial Sequence
  Guide Sequence
cuccuggagccugggcuaguc

SEQ ID NO: 10863 - RNA, 21 nt, Artificial Sequence
  Guide Sequence
cucugauaggaggggccugag

SEQ ID NO: 10864 - RNA, 21 nt, Artificial Sequence
  Guide Sequence
cucuuccuugacaaacagccc

SEQ ID NO: 10865 - RNA, 21 nt, Artificial Sequence
  Guide Sequence
cugaaaacacacacuaacacc

SEQ ID NO: 10866 - RNA, 21 nt, Artificial Sequence
  Guide Sequence
cugacagcccccucuccucac

SEQ ID NO: 10867 - RNA, 21 nt, Artificial Sequence
  Guide Sequence
cugaggggcugggcagacuau

SEQ ID NO: 10868 - RNA, 21 nt, Artificial Sequence
  Guide Sequence
cugauaggaggggccugaggg

SEQ ID NO: 10869 - RNA, 21 nt, Artificial Sequence
  Guide Sequence
cugcacccugggugggcacuc

SEQ ID NO: 10870 - RNA, 21 nt, Artificial Sequence
  Guide Sequence
cugcagaauccccuccugccu

SEQ ID NO: 10871 - RNA, 21 nt, Artificial Sequence
  Guide Sequence
cugccucugauaggaggggcc

SEQ ID NO: 10872 - RNA, 21 nt, Artificial Sequence
  Guide Sequence
cugccugccucugauaggagg

SEQ ID NO: 10873 - RNA, 21 nt, Artificial Sequence
  Guide Sequence
cuggagccugggcuagucagc

SEQ ID NO: 10874 - RNA, 21 nt, Artificial Sequence
  Guide Sequence
cugggcagacuaugcaggacc

SEQ ID NO: 10875 - RNA, 21 nt, Artificial Sequence
  Guide Sequence
cugggcuagucagccagagag

SEQ ID NO: 10876 - RNA, 21 nt, Artificial Sequence
  Guide Sequence
cuggggguagugugagaggga

SEQ ID NO: 10877 - RNA, 21 nt, Artificial Sequence
  Guide Sequence
cugggugggcacucccaccau

SEQ ID NO: 10878 - RNA, 21 nt, Artificial Sequence
  Guide Sequence
cuguuugcuuuucugcagaau

SEQ ID NO: 10879 - RNA, 21 nt, Artificial Sequence
  Guide Sequence
cuguuuuauaagaagggaaac

SEQ ID NO: 10880 - RNA, 21 nt, Artificial Sequence
  Guide Sequence
cuuccuugacaaacagcccug

SEQ ID NO: 10881 - RNA, 21 nt, Artificial Sequence
  Guide Sequence
cuugacaaacagcccugcacc

SEQ ID NO: 10882 - RNA, 21 nt, Artificial Sequence
  Guide Sequence
cuugaucaaggucucagguaa

SEQ ID NO: 10883 - RNA, 21 nt, Artificial Sequence
  Guide Sequence
cuuguguguaaacagcuaauu

SEQ ID NO: 10884 - RNA, 21 nt, Artificial Sequence
  Guide Sequence
cuuuucugcagaauccccucc

SEQ ID NO: 10885 - RNA, 21 nt, Artificial Sequence
  Guide Sequence
gaaaacacacacuaacaccca

SEQ ID NO: 10886 - RNA, 21 nt, Artificial Sequence
  Guide Sequence
gaaaaguuaacgagcaggcua

SEQ ID NO: 10887 - RNA, 21 nt, Artificial Sequence
  Guide Sequence
gaaacugaaaacacacacuaa

SEQ ID NO: 10888 - RNA, 21 nt, Artificial Sequence
  Guide Sequence
gaaacugacagcccccucucc

SEQ ID NO: 10889 - RNA, 21 nt, Artificial Sequence
  Guide Sequence
gaaagcagauagucgcuaaau

SEQ ID NO: 10890 - RNA, 21 nt, Artificial Sequence
  Guide Sequence
gaagggaaacugaaaacacac

SEQ ID NO: 10891 - RNA, 21 nt, Artificial Sequence
  Guide Sequence
gaauccccuccugccugccuc

SEQ ID NO: 10892 - RNA, 21 nt, Artificial Sequence
  Guide Sequence
gaauugaugaccgggccucaa

SEQ ID NO: 10893 - RNA, 21 nt, Artificial Sequence
  Guide Sequence
gacaaacagcccugcacccug

SEQ ID NO: 10894 - RNA, 21 nt, Artificial Sequence
  Guide Sequence
gacagcccccucuccucaccc

SEQ ID NO: 10895 - RNA, 21 nt, Artificial Sequence
  Guide Sequence
gaccauucguuggggaauuga

SEQ ID NO: 10896 - RNA, 21 nt, Artificial Sequence
  Guide Sequence
gaccgggccucaaggcuacuc

SEQ ID NO: 10897 - RNA, 21 nt, Artificial Sequence
  Guide Sequence
gacuaugcaggaccauucguu

SEQ ID NO: 10898 - RNA, 21 nt, Artificial Sequence
  Guide Sequence
gagagggagauuuaagggucu

SEQ ID NO: 10899 - RNA, 21 nt, Artificial Sequence
  Guide Sequence
gagaggucggggugaggcccc

SEQ ID NO: 10900 - RNA, 21 nt, Artificial Sequence
  Guide Sequence
gagauuuaagggucuugauca

SEQ ID NO: 10901 - RNA, 21 nt, Artificial Sequence
  Guide Sequence
gagcaggcuaaugaaagcaga

SEQ ID NO: 10902 - RNA, 21 nt, Artificial Sequence
  Guide Sequence
gagccugggcuagucagccag

SEQ ID NO: 10903 - RNA, 21 nt, Artificial Sequence
  Guide Sequence
gaggccccgugcuguuugcuu

SEQ ID NO: 10904 - RNA, 21 nt, Artificial Sequence
  Guide Sequence
gagggagauuuaagggucuug

SEQ ID NO: 10905 - RNA, 21 nt, Artificial Sequence
  Guide Sequence
gaggggcugggcagacuaugc

SEQ ID NO: 10906 - RNA, 21 nt, Artificial Sequence
  Guide Sequence
gaggucggggugaggccccgu

SEQ ID NO: 10907 - RNA, 21 nt, Artificial Sequence
  Guide Sequence
gauaggaggggccugaggggc

SEQ ID NO: 10908 - RNA, 21 nt, Artificial Sequence
  Guide Sequence
gauagucgcuaaauuacccuc

SEQ ID NO: 10909 - RNA, 21 nt, Artificial Sequence
  Guide Sequence
gaucaaggucucagguaaaca

SEQ ID NO: 10910 - RNA, 21 nt, Artificial Sequence
  Guide Sequence
gaugaccgggccucaaggcua

SEQ ID NO: 10911 - RNA, 21 nt, Artificial Sequence
  Guide Sequence
gauuuaagggucuugaucaag

SEQ ID NO: 10912 - RNA, 21 nt, Artificial Sequence
  Guide Sequence
gcacccugggugggcacuccc

SEQ ID NO: 10913 - RNA, 21 nt, Artificial Sequence
  Guide Sequence
gcacucccaccaucuccaggg

SEQ ID NO: 10914 - RNA, 21 nt, Artificial Sequence
  Guide Sequence
gcagaauccccuccugccugc

SEQ ID NO: 10915 - RNA, 21 nt, Artificial Sequence
  Guide Sequence
gcagacuaugcaggaccauuc

SEQ ID NO: 10916 - RNA, 21 nt, Artificial Sequence
  Guide Sequence
gcagauagucgcuaaauuacc

SEQ ID NO: 10917 - RNA, 21 nt, Artificial Sequence
  Guide Sequence
gcaggaccauucguuggggaa

SEQ ID NO: 10918 - RNA, 21 nt, Artificial Sequence
  Guide Sequence
gcaggcuaaugaaagcagaua

SEQ ID NO: 10919 - RNA, 21 nt, Artificial Sequence
  Guide Sequence
gccaacuucuuuagugguuac

SEQ ID NO: 10920 - RNA, 21 nt, Artificial Sequence
  Guide Sequence
gccagagaggucggggugagg

SEQ ID NO: 10921 - RNA, 21 nt, Artificial Sequence
  Guide Sequence
gcccccucuccucacccaccc

SEQ ID NO: 10922 - RNA, 21 nt, Artificial Sequence
  Guide Sequence
gccccgugcuguuugcuuuuc

SEQ ID NO: 10923 - RNA, 21 nt, Artificial Sequence
  Guide Sequence
gcccugcacccugggugggca

SEQ ID NO: 10924 - RNA, 21 nt, Artificial Sequence
  Guide Sequence
gccucaaggcuacuccaucaa

SEQ ID NO: 10925 - RNA, 21 nt, Artificial Sequence
  Guide Sequence
gccucugauaggaggggccug

SEQ ID NO: 10926 - RNA, 21 nt, Artificial Sequence
  Guide Sequence
gccugaggggcugggcagacu

SEQ ID NO: 10927 - RNA, 21 nt, Artificial Sequence
  Guide Sequence
gccugccucugauaggagggg

SEQ ID NO: 10928 - RNA, 21 nt, Artificial Sequence
  Guide Sequence
gccugggcuagucagccagag

SEQ ID NO: 10929 - RNA, 21 nt, Artificial Sequence
  Guide Sequence
gcuaaauuacccuccuggagc

SEQ ID NO: 10930 - RNA, 21 nt, Artificial Sequence
  Guide Sequence
gcuaaugaaagcagauagucg

SEQ ID NO: 10931 - RNA, 21 nt, Artificial Sequence
  Guide Sequence
gcuagcucuuccuugacaaac

SEQ ID NO: 10932 - RNA, 21 nt, Artificial Sequence
  Guide Sequence
gcuagucagccagagaggucg

SEQ ID NO: 10933 - RNA, 21 nt, Artificial Sequence
  Guide Sequence
gcucuuccuugacaaacagcc

SEQ ID NO: 10934 - RNA, 21 nt, Artificial Sequence
  Guide Sequence
gcugggcagacuaugcaggac

SEQ ID NO: 10935 - RNA, 21 nt, Artificial Sequence
  Guide Sequence
gcuguuugcuuuucugcagaa

SEQ ID NO: 10936 - RNA, 21 nt, Artificial Sequence
  Guide Sequence
gcuuuucugcagaauccccuc

SEQ ID NO: 10937 - RNA, 21 nt, Artificial Sequence
  Guide Sequence
ggaaaaguuaacgagcaggcu

SEQ ID NO: 10938 - RNA, 21 nt, Artificial Sequence
  Guide Sequence
ggaaacugaaaacacacacua

SEQ ID NO: 10939 - RNA, 21 nt, Artificial Sequence
  Guide Sequence
ggaauugaugaccgggccuca

SEQ ID NO: 10940 - RNA, 21 nt, Artificial Sequence
  Guide Sequence
ggaccauucguuggggaauug

SEQ ID NO: 10941 - RNA, 21 nt, Artificial Sequence
  Guide Sequence
ggagauuuaagggucuugauc

SEQ ID NO: 10942 - RNA, 21 nt, Artificial Sequence
  Guide Sequence
ggagccugggcuagucagcca

SEQ ID NO: 10943 - RNA, 21 nt, Artificial Sequence
  Guide Sequence
ggcacucccaccaucuccagg

SEQ ID NO: 10944 - RNA, 21 nt, Artificial Sequence
  Guide Sequence
ggcagacuaugcaggaccauu

SEQ ID NO: 10945 - RNA, 21 nt, Artificial Sequence
  Guide Sequence
ggccaacuucuuuagugguua

SEQ ID NO: 10946 - RNA, 21 nt, Artificial Sequence
  Guide Sequence
ggccccgugcuguuugcuuuu

SEQ ID NO: 10947 - RNA, 21 nt, Artificial Sequence
  Guide Sequence
ggccucaaggcuacuccauca

SEQ ID NO: 10948 - RNA, 21 nt, Artificial Sequence
  Guide Sequence
ggccugaggggcugggcagac

SEQ ID NO: 10949 - RNA, 21 nt, Artificial Sequence
  Guide Sequence
ggcuaaugaaagcagauaguc

SEQ ID NO: 10950 - RNA, 21 nt, Artificial Sequence
  Guide Sequence
ggcuagcucuuccuugacaaa

SEQ ID NO: 10951 - RNA, 21 nt, Artificial Sequence
  Guide Sequence
ggcuagucagccagagagguc

SEQ ID NO: 10952 - RNA, 21 nt, Artificial Sequence
  Guide Sequence
ggcugggcagacuaugcagga

SEQ ID NO: 10953 - RNA, 21 nt, Artificial Sequence
  Guide Sequence
gggaaaaguuaacgagcaggc

SEQ ID NO: 10954 - RNA, 21 nt, Artificial Sequence
  Guide Sequence
gggaaacugaaaacacacacu

SEQ ID NO: 10955 - RNA, 21 nt, Artificial Sequence
  Guide Sequence
gggaauugaugaccgggccuc

SEQ ID NO: 10956 - RNA, 21 nt, Artificial Sequence
  Guide Sequence
gggagauuuaagggucuugau

SEQ ID NO: 10957 - RNA, 21 nt, Artificial Sequence
  Guide Sequence
gggcacucccaccaucuccag

SEQ ID NO: 10958 - RNA, 21 nt, Artificial Sequence
  Guide Sequence
gggcagacuaugcaggaccau

SEQ ID NO: 10959 - RNA, 21 nt, Artificial Sequence
  Guide Sequence
gggccaacuucuuuagugguu

SEQ ID NO: 10960 - RNA, 21 nt, Artificial Sequence
  Guide Sequence
gggccucaaggcuacuccauc

SEQ ID NO: 10961 - RNA, 21 nt, Artificial Sequence
  Guide Sequence
gggccugaggggcugggcaga

SEQ ID NO: 10962 - RNA, 21 nt, Artificial Sequence
  Guide Sequence
gggcuagucagccagagaggu

SEQ ID NO: 10963 - RNA, 21 nt, Artificial Sequence
  Guide Sequence
gggcugggcagacuaugcagg

SEQ ID NO: 10964 - RNA, 21 nt, Artificial Sequence
  Guide Sequence
ggggaauugaugaccgggccu

SEQ ID NO: 10965 - RNA, 21 nt, Artificial Sequence
  Guide Sequence
ggggcugggcagacuaugcag

SEQ ID NO: 10966 - RNA, 21 nt, Artificial Sequence
  Guide Sequence
ggggguagugugagagggaga

SEQ ID NO: 10967 - RNA, 21 nt, Artificial Sequence
  Guide Sequence
gggguagugugagagggagau

SEQ ID NO: 10968 - RNA, 21 nt, Artificial Sequence
  Guide Sequence
ggggugaggccccgugcuguu

SEQ ID NO: 10969 - RNA, 21 nt, Artificial Sequence
  Guide Sequence
ggguagugugagagggagauu

SEQ ID NO: 10970 - RNA, 21 nt, Artificial Sequence
  Guide Sequence
gggucuugaucaaggucucag

SEQ ID NO: 10971 - RNA, 21 nt, Artificial Sequence
  Guide Sequence
gggugaggccccgugcuguuu

SEQ ID NO: 10972 - RNA, 21 nt, Artificial Sequence
  Guide Sequence
gggugggcacucccaccaucu

SEQ ID NO: 10973 - RNA, 21 nt, Artificial Sequence
  Guide Sequence
gguaaacaauuccuugugugu

SEQ ID NO: 10974 - RNA, 21 nt, Artificial Sequence
  Guide Sequence
gguagugugagagggagauuu

SEQ ID NO: 10975 - RNA, 21 nt, Artificial Sequence
  Guide Sequence
ggucucagguaaacaauuccu

SEQ ID NO: 10976 - RNA, 21 nt, Artificial Sequence
  Guide Sequence
ggucuugaucaaggucucagg

SEQ ID NO: 10977 - RNA, 21 nt, Artificial Sequence
  Guide Sequence
ggugaggccccgugcuguuug

SEQ ID NO: 10978 - RNA, 21 nt, Artificial Sequence
  Guide Sequence
ggugggcacucccaccaucuc

SEQ ID NO: 10979 - RNA, 21 nt, Artificial Sequence
  Guide Sequence
guaaacaauuccuugugugua

SEQ ID NO: 10980 - RNA, 21 nt, Artificial Sequence
  Guide Sequence
guaaacagcuaauucucacug

SEQ ID NO: 10981 - RNA, 21 nt, Artificial Sequence
  Guide Sequence
guagugugagagggagauuua

SEQ ID NO: 10982 - RNA, 21 nt, Artificial Sequence
  Guide Sequence
gucagccagagaggucggggu

SEQ ID NO: 10983 - RNA, 21 nt, Artificial Sequence
  Guide Sequence
gucgcuaaauuacccuccugg

SEQ ID NO: 10984 - RNA, 21 nt, Artificial Sequence
  Guide Sequence
gucggggugaggccccgugcu

SEQ ID NO: 10985 - RNA, 21 nt, Artificial Sequence
  Guide Sequence
gucucagguaaacaauuccuu

SEQ ID NO: 10986 - RNA, 21 nt, Artificial Sequence
  Guide Sequence
gucuugaucaaggucucaggu

SEQ ID NO: 10987 - RNA, 21 nt, Artificial Sequence
  Guide Sequence
gugagagggagauuuaagggu

SEQ ID NO: 10988 - RNA, 21 nt, Artificial Sequence
  Guide Sequence
gugaggccccgugcuguuugc

SEQ ID NO: 10989 - RNA, 21 nt, Artificial Sequence
  Guide Sequence
gugcuguuugcuuuucugcag

SEQ ID NO: 10990 - RNA, 21 nt, Artificial Sequence
  Guide Sequence
gugggcacucccaccaucucc

SEQ ID NO: 10991 - RNA, 21 nt, Artificial Sequence
  Guide Sequence
guguaaacagcuaauucucac

SEQ ID NO: 10992 - RNA, 21 nt, Artificial Sequence
  Guide Sequence
gugugagagggagauuuaagg

SEQ ID NO: 10993 - RNA, 21 nt, Artificial Sequence
  Guide Sequence
guguguaaacagcuaauucuc

SEQ ID NO: 10994 - RNA, 21 nt, Artificial Sequence
  Guide Sequence
guuaacgagcaggcuaaugaa

SEQ ID NO: 10995 - RNA, 21 nt, Artificial Sequence
  Guide Sequence
guuggggaauugaugaccggg

SEQ ID NO: 10996 - RNA, 21 nt, Artificial Sequence
  Guide Sequence
guuugcuuuucugcagaaucc

SEQ ID NO: 10997 - RNA, 21 nt, Artificial Sequence
  Guide Sequence
guuuuauaagaagggaaacug

SEQ ID NO: 10998 - RNA, 21 nt, Artificial Sequence
  Guide Sequence
uaaacagcuaauucucacugu

SEQ ID NO: 10999 - RNA, 21 nt, Artificial Sequence
  Guide Sequence
uaaauuacccuccuggagccu

SEQ ID NO: 11000 - RNA, 21 nt, Artificial Sequence
  Guide Sequence
uaacacccagaaacugacagc

SEQ ID NO: 11001 - RNA, 21 nt, Artificial Sequence
  Guide Sequence
uaacgagcaggcuaaugaaag

SEQ ID NO: 11002 - RNA, 21 nt, Artificial Sequence
  Guide Sequence
uaagaagggaaacugaaaaca

SEQ ID NO: 11003 - RNA, 21 nt, Artificial Sequence
  Guide Sequence
uaagggucuugaucaaggucu

SEQ ID NO: 11004 - RNA, 21 nt, Artificial Sequence
  Guide Sequence
uaaugaaagcagauagucgcu

SEQ ID NO: 11005 - RNA, 21 nt, Artificial Sequence
  Guide Sequence
uacccuccuggagccugggcu

SEQ ID NO: 11006 - RNA, 21 nt, Artificial Sequence
  Guide Sequence
uagcucuuccuugacaaacag

SEQ ID NO: 11007 - RNA, 21 nt, Artificial Sequence
  Guide Sequence
uaggaggggccugaggggcug

SEQ ID NO: 11008 - RNA, 21 nt, Artificial Sequence
  Guide Sequence
uagucagccagagaggucggg

SEQ ID NO: 11009 - RNA, 21 nt, Artificial Sequence
  Guide Sequence
uagucgcuaaauuacccuccu

SEQ ID NO: 11010 - RNA, 21 nt, Artificial Sequence
  Guide Sequence
uagugugagagggagauuuaa

SEQ ID NO: 11011 - RNA, 21 nt, Artificial Sequence
  Guide Sequence
uaugcaggaccauucguuggg

SEQ ID NO: 11012 - RNA, 21 nt, Artificial Sequence
  Guide Sequence
ucaaggcuacuccaucaaugc

SEQ ID NO: 11013 - RNA, 21 nt, Artificial Sequence
  Guide Sequence
ucaaggucucagguaaacaau

SEQ ID NO: 11014 - RNA, 21 nt, Artificial Sequence
  Guide Sequence
ucacuguuuuauaagaaggga

SEQ ID NO: 11015 - RNA, 21 nt, Artificial Sequence
  Guide Sequence
ucagccagagaggucggggug

SEQ ID NO: 11016 - RNA, 21 nt, Artificial Sequence
  Guide Sequence
ucagguaaacaauuccuugug

SEQ ID NO: 11017 - RNA, 21 nt, Artificial Sequence
  Guide Sequence
uccagggccaacuucuuuagu

SEQ ID NO: 11018 - RNA, 21 nt, Artificial Sequence
  Guide Sequence
ucccaccaucuccagggccaa

SEQ ID NO: 11019 - RNA, 21 nt, Artificial Sequence
  Guide Sequence
uccccuccugccugccucuga

SEQ ID NO: 11020 - RNA, 21 nt, Artificial Sequence
  Guide Sequence
uccugccugccucugauagga

SEQ ID NO: 11021 - RNA, 21 nt, Artificial Sequence
  Guide Sequence
uccuggagccugggcuaguca

SEQ ID NO: 11022 - RNA, 21 nt, Artificial Sequence
  Guide Sequence
uccuugacaaacagcccugca

SEQ ID NO: 11023 - RNA, 21 nt, Artificial Sequence
  Guide Sequence
uccuuguguguaaacagcuaa

SEQ ID NO: 11024 - RNA, 21 nt, Artificial Sequence
  Guide Sequence
ucgcuaaauuacccuccugga

SEQ ID NO: 11025 - RNA, 21 nt, Artificial Sequence
  Guide Sequence
ucggggugaggccccgugcug

SEQ ID NO: 11026 - RNA, 21 nt, Artificial Sequence
  Guide Sequence
ucguuggggaauugaugaccg

SEQ ID NO: 11027 - RNA, 21 nt, Artificial Sequence
  Guide Sequence
ucucacuguuuuauaagaagg

SEQ ID NO: 11028 - RNA, 21 nt, Artificial Sequence
  Guide Sequence
ucucagguaaacaauuccuug

SEQ ID NO: 11029 - RNA, 21 nt, Artificial Sequence
  Guide Sequence
ucuccagggccaacuucuuua

SEQ ID NO: 11030 - RNA, 21 nt, Artificial Sequence
  Guide Sequence
ucugauaggaggggccugagg

SEQ ID NO: 11031 - RNA, 21 nt, Artificial Sequence
  Guide Sequence
ucugcagaauccccuccugcc

SEQ ID NO: 11032 - RNA, 21 nt, Artificial Sequence
  Guide Sequence
ucuuccuugacaaacagcccu

SEQ ID NO: 11033 - RNA, 21 nt, Artificial Sequence
  Guide Sequence
ucuugaucaaggucucaggua

SEQ ID NO: 11034 - RNA, 21 nt, Artificial Sequence
  Guide Sequence
ugaaaacacacacuaacaccc

SEQ ID NO: 11035 - RNA, 21 nt, Artificial Sequence
  Guide Sequence
ugaaagcagauagucgcuaaa

SEQ ID NO: 11036 - RNA, 21 nt, Artificial Sequence
  Guide Sequence
ugacaaacagcccugcacccu

SEQ ID NO: 11037 - RNA, 21 nt, Artificial Sequence
  Guide Sequence
ugacagcccccucuccucacc

SEQ ID NO: 11038 - RNA, 21 nt, Artificial Sequence
  Guide Sequence
ugaccgggccucaaggcuacu

SEQ ID NO: 11039 - RNA, 21 nt, Artificial Sequence
  Guide Sequence
ugagagggagauuuaaggguc

SEQ ID NO: 11040 - RNA, 21 nt, Artificial Sequence
  Guide Sequence
ugaggccccgugcuguuugcu

SEQ ID NO: 11041 - RNA, 21 nt, Artificial Sequence
  Guide Sequence
ugaggggcugggcagacuaug

SEQ ID NO: 11042 - RNA, 21 nt, Artificial Sequence
  Guide Sequence
ugauaggaggggccugagggg

SEQ ID NO: 11043 - RNA, 21 nt, Artificial Sequence
  Guide Sequence
ugaucaaggucucagguaaac

SEQ ID NO: 11044 - RNA, 21 nt, Artificial Sequence
  Guide Sequence
ugaugaccgggccucaaggcu

SEQ ID NO: 11045 - RNA, 21 nt, Artificial Sequence
  Guide Sequence
ugcacccugggugggcacucc

SEQ ID NO: 11046 - RNA, 21 nt, Artificial Sequence
  Guide Sequence
ugcagaauccccuccugccug

SEQ ID NO: 11047 - RNA, 21 nt, Artificial Sequence
  Guide Sequence
ugcaggaccauucguugggga

SEQ ID NO: 11048 - RNA, 21 nt, Artificial Sequence
  Guide Sequence
ugccucugauaggaggggccu

SEQ ID NO: 11049 - RNA, 21 nt, Artificial Sequence
  Guide Sequence
ugccugccucugauaggaggg

SEQ ID NO: 11050 - RNA, 21 nt, Artificial Sequence
  Guide Sequence
ugcuguuugcuuuucugcaga

SEQ ID NO: 11051 - RNA, 21 nt, Artificial Sequence
  Guide Sequence
ugcuuuucugcagaauccccu

SEQ ID NO: 11052 - RNA, 21 nt, Artificial Sequence
  Guide Sequence
uggagccugggcuagucagcc

SEQ ID NO: 11053 - RNA, 21 nt, Artificial Sequence
  Guide Sequence
ugggaaaaguuaacgagcagg

SEQ ID NO: 11054 - RNA, 21 nt, Artificial Sequence
  Guide Sequence
ugggcacucccaccaucucca

SEQ ID NO: 11055 - RNA, 21 nt, Artificial Sequence
  Guide Sequence
ugggcagacuaugcaggacca

SEQ ID NO: 11056 - RNA, 21 nt, Artificial Sequence
  Guide Sequence
ugggcuagucagccagagagg

SEQ ID NO: 11057 - RNA, 21 nt, Artificial Sequence
  Guide Sequence
uggggaauugaugaccgggcc

SEQ ID NO: 11058 - RNA, 21 nt, Artificial Sequence
  Guide Sequence
uggggguagugugagagggag

SEQ ID NO: 11059 - RNA, 21 nt, Artificial Sequence
  Guide Sequence
ugggugggcacucccaccauc

SEQ ID NO: 11060 - RNA, 21 nt, Artificial Sequence
  Guide Sequence
uguaaacagcuaauucucacu

SEQ ID NO: 11061 - RNA, 21 nt, Artificial Sequence
  Guide Sequence
ugugagagggagauuuaaggg

SEQ ID NO: 11062 - RNA, 21 nt, Artificial Sequence
  Guide Sequence
uguguaaacagcuaauucuca

SEQ ID NO: 11063 - RNA, 21 nt, Artificial Sequence
  Guide Sequence
uguguguaaacagcuaauucu

SEQ ID NO: 11064 - RNA, 21 nt, Artificial Sequence
  Guide Sequence
uguuugcuuuucugcagaauc

SEQ ID NO: 11065 - RNA, 21 nt, Artificial Sequence
  Guide Sequence
uuaacgagcaggcuaaugaaa

SEQ ID NO: 11066 - RNA, 21 nt, Artificial Sequence
  Guide Sequence
uuaagggucuugaucaagguc

SEQ ID NO: 11067 - RNA, 21 nt, Artificial Sequence
  Guide Sequence
uuacccuccuggagccugggc

SEQ ID NO: 11068 - RNA, 21 nt, Artificial Sequence
  Guide Sequence
uuccuugacaaacagcccugc

SEQ ID NO: 11069 - RNA, 21 nt, Artificial Sequence
  Guide Sequence
uuccuuguguguaaacagcua

SEQ ID NO: 11070 - RNA, 21 nt, Artificial Sequence
  Guide Sequence
uucguuggggaauugaugacc

SEQ ID NO: 11071 - RNA, 21 nt, Artificial Sequence
  Guide Sequence
uucugcagaauccccuccugc

SEQ ID NO: 11072 - RNA, 21 nt, Artificial Sequence
  Guide Sequence
uugacaaacagcccugcaccc

SEQ ID NO: 11073 - RNA, 21 nt, Artificial Sequence
  Guide Sequence
uugaucaaggucucagguaaa

SEQ ID NO: 11074 - RNA, 21 nt, Artificial Sequence
  Guide Sequence
uugaugaccgggccucaaggc

SEQ ID NO: 11075 - RNA, 21 nt, Artificial Sequence
  Guide Sequence
uugcuuuucugcagaaucccc

SEQ ID NO: 11076 - RNA, 21 nt, Artificial Sequence
  Guide Sequence
uuggggaauugaugaccgggc

SEQ ID NO: 11077 - RNA, 21 nt, Artificial Sequence
  Guide Sequence
uuguguguaaacagcuaauuc

SEQ ID NO: 11078 - RNA, 21 nt, Artificial Sequence
  Guide Sequence
uuuaagggucuugaucaaggu

SEQ ID NO: 11079 - RNA, 21 nt, Artificial Sequence
  Guide Sequence
uuucugcagaauccccuccug

SEQ ID NO: 11080 - RNA, 21 nt, Artificial Sequence
  Guide Sequence
uuugcuuuucugcagaauccc

SEQ ID NO: 11081 - RNA, 21 nt, Artificial Sequence
  Guide Sequence
uuuucugcagaauccccuccu

SEQ ID NO: 11082 - RNA, 22 nt, Artificial Sequence
  Guide Sequence
aaaacacacacuaacacccaga

SEQ ID NO: 11083 - RNA, 22 nt, Artificial Sequence
  Guide Sequence
aaaaguuaacgagcaggcuaau

SEQ ID NO: 11084 - RNA, 22 nt, Artificial Sequence
  Guide Sequence
aaacaauuccuuguguguaaac

SEQ ID NO: 11085 - RNA, 22 nt, Artificial Sequence
  Guide Sequence
aaacacacacuaacacccagaa

SEQ ID NO: 11086 - RNA, 22 nt, Artificial Sequence
  Guide Sequence
aaacagcccugcacccugggug

SEQ ID NO: 11087 - RNA, 22 nt, Artificial Sequence
  Guide Sequence
aaacagcuaauucucacuguuu

SEQ ID NO: 11088 - RNA, 22 nt, Artificial Sequence
  Guide Sequence
aaacugaaaacacacacuaaca

SEQ ID NO: 11089 - RNA, 22 nt, Artificial Sequence
  Guide Sequence
aaacugacagcccccucuccuc

SEQ ID NO: 11090 - RNA, 22 nt, Artificial Sequence
  Guide Sequence
aaagcagauagucgcuaaauua

SEQ ID NO: 11091 - RNA, 22 nt, Artificial Sequence
  Guide Sequence
aaaguuaacgagcaggcuaaug

SEQ ID NO: 11092 - RNA, 22 nt, Artificial Sequence
  Guide Sequence
aaauuacccuccuggagccugg

SEQ ID NO: 11093 - RNA, 22 nt, Artificial Sequence
  Guide Sequence
aacaauuccuuguguguaaaca

SEQ ID NO: 11094 - RNA, 22 nt, Artificial Sequence
  Guide Sequence
aacacacacuaacacccagaaa

SEQ ID NO: 11095 - RNA, 22 nt, Artificial Sequence
  Guide Sequence
aacacccagaaacugacagccc

SEQ ID NO: 11096 - RNA, 22 nt, Artificial Sequence
  Guide Sequence
aacagcccugcacccugggugg

SEQ ID NO: 11097 - RNA, 22 nt, Artificial Sequence
  Guide Sequence
aacagcuaauucucacuguuuu

SEQ ID NO: 11098 - RNA, 22 nt, Artificial Sequence
  Guide Sequence
aacgagcaggcuaaugaaagca

SEQ ID NO: 11099 - RNA, 22 nt, Artificial Sequence
  Guide Sequence
aacugaaaacacacacuaacac

SEQ ID NO: 11100 - RNA, 22 nt, Artificial Sequence
  Guide Sequence
aacugacagcccccucuccuca

SEQ ID NO: 11101 - RNA, 22 nt, Artificial Sequence
  Guide Sequence
aagaagggaaacugaaaacaca

SEQ ID NO: 11102 - RNA, 22 nt, Artificial Sequence
  Guide Sequence
aagcagauagucgcuaaauuac

SEQ ID NO: 11103 - RNA, 22 nt, Artificial Sequence
  Guide Sequence
aaggcuacuccaucaaugcagc

SEQ ID NO: 11104 - RNA, 22 nt, Artificial Sequence
  Guide Sequence
aagggaaacugaaaacacacac

SEQ ID NO: 11105 - RNA, 22 nt, Artificial Sequence
  Guide Sequence
aagggucuugaucaaggucuca

SEQ ID NO: 11106 - RNA, 22 nt, Artificial Sequence
  Guide Sequence
aaggucucagguaaacaauucc

SEQ ID NO: 11107 - RNA, 22 nt, Artificial Sequence
  Guide Sequence
aaguuaacgagcaggcuaauga

SEQ ID NO: 11108 - RNA, 22 nt, Artificial Sequence
  Guide Sequence
aauccccuccugccugccucug

SEQ ID NO: 11109 - RNA, 22 nt, Artificial Sequence
  Guide Sequence
aaugaaagcagauagucgcuaa

SEQ ID NO: 11110 - RNA, 22 nt, Artificial Sequence
  Guide Sequence
aauuacccuccuggagccuggg

SEQ ID NO: 11111 - RNA, 22 nt, Artificial Sequence
  Guide Sequence
aauuccuuguguguaaacagcu

SEQ ID NO: 11112 - RNA, 22 nt, Artificial Sequence
  Guide Sequence
aauugaugaccgggccucaagg

SEQ ID NO: 11113 - RNA, 22 nt, Artificial Sequence
  Guide Sequence
acaaacagcccugcacccuggg

SEQ ID NO: 11114 - RNA, 22 nt, Artificial Sequence
  Guide Sequence
acaauuccuuguguguaaacag

SEQ ID NO: 11115 - RNA, 22 nt, Artificial Sequence
  Guide Sequence
acacacacuaacacccagaaac

SEQ ID NO: 11116 - RNA, 22 nt, Artificial Sequence
  Guide Sequence
acacacuaacacccagaaacug

SEQ ID NO: 11117 - RNA, 22 nt, Artificial Sequence
  Guide Sequence
acacccagaaacugacagcccc

SEQ ID NO: 11118 - RNA, 22 nt, Artificial Sequence
  Guide Sequence
acacuaacacccagaaacugac

SEQ ID NO: 11119 - RNA, 22 nt, Artificial Sequence
  Guide Sequence
acagcccccucuccucacccac

SEQ ID NO: 11120 - RNA, 22 nt, Artificial Sequence
  Guide Sequence
acagcccugcacccuggguggg

SEQ ID NO: 11121 - RNA, 22 nt, Artificial Sequence
  Guide Sequence
acagcuaauucucacuguuuua

SEQ ID NO: 11122 - RNA, 22 nt, Artificial Sequence
  Guide Sequence
accaucuccagggccaacuucu

SEQ ID NO: 11123 - RNA, 22 nt, Artificial Sequence
  Guide Sequence
accauucguuggggaauugaug

SEQ ID NO: 11124 - RNA, 22 nt, Artificial Sequence
  Guide Sequence
acccagaaacugacagcccccu

SEQ ID NO: 11125 - RNA, 22 nt, Artificial Sequence
  Guide Sequence
acccuccuggagccugggcuag

SEQ ID NO: 11126 - RNA, 22 nt, Artificial Sequence
  Guide Sequence
acccugggugggcacucccacc

SEQ ID NO: 11127 - RNA, 22 nt, Artificial Sequence
  Guide Sequence
accgggccucaaggcuacucca

SEQ ID NO: 11128 - RNA, 22 nt, Artificial Sequence
  Guide Sequence
acgagcaggcuaaugaaagcag

SEQ ID NO: 11129 - RNA, 22 nt, Artificial Sequence
  Guide Sequence
acuaacacccagaaacugacag

SEQ ID NO: 11130 - RNA, 22 nt, Artificial Sequence
  Guide Sequence
acuaugcaggaccauucguugg

SEQ ID NO: 11131 - RNA, 22 nt, Artificial Sequence
  Guide Sequence
acucccaccaucuccagggcca

SEQ ID NO: 11132 - RNA, 22 nt, Artificial Sequence
  Guide Sequence
acugaaaacacacacuaacacc

SEQ ID NO: 11133 - RNA, 22 nt, Artificial Sequence
  Guide Sequence
acugacagcccccucuccucac

SEQ ID NO: 11134 - RNA, 22 nt, Artificial Sequence
  Guide Sequence
acuguuuuauaagaagggaaac

SEQ ID NO: 11135 - RNA, 22 nt, Artificial Sequence
  Guide Sequence
agaaacugacagcccccucucc

SEQ ID NO: 11136 - RNA, 22 nt, Artificial Sequence
  Guide Sequence
agaagggaaacugaaaacacac

SEQ ID NO: 11137 - RNA, 22 nt, Artificial Sequence
  Guide Sequence
agaauccccuccugccugccuc

SEQ ID NO: 11138 - RNA, 22 nt, Artificial Sequence
  Guide Sequence
agacuaugcaggaccauucguu

SEQ ID NO: 11139 - RNA, 22 nt, Artificial Sequence
  Guide Sequence
agagaggucggggugaggcccc

SEQ ID NO: 11140 - RNA, 22 nt, Artificial Sequence
  Guide Sequence
agagggagauuuaagggucuug

SEQ ID NO: 11141 - RNA, 22 nt, Artificial Sequence
  Guide Sequence
agaggucggggugaggccccgu

SEQ ID NO: 11142 - RNA, 22 nt, Artificial Sequence
  Guide Sequence
agauagucgcuaaauuacccuc

SEQ ID NO: 11143 - RNA, 22 nt, Artificial Sequence
  Guide Sequence
agauuuaagggucuugaucaag

SEQ ID NO: 11144 - RNA, 22 nt, Artificial Sequence
  Guide Sequence
agcagauagucgcuaaauuacc

SEQ ID NO: 11145 - RNA, 22 nt, Artificial Sequence
  Guide Sequence
agcaggcuaaugaaagcagaua

SEQ ID NO: 11146 - RNA, 22 nt, Artificial Sequence
  Guide Sequence
agccagagaggucggggugagg

SEQ ID NO: 11147 - RNA, 22 nt, Artificial Sequence
  Guide Sequence
agcccccucuccucacccaccc

SEQ ID NO: 11148 - RNA, 22 nt, Artificial Sequence
  Guide Sequence
agcccugcacccugggugggca

SEQ ID NO: 11149 - RNA, 22 nt, Artificial Sequence
  Guide Sequence
agccugggcuagucagccagag

SEQ ID NO: 11150 - RNA, 22 nt, Artificial Sequence
  Guide Sequence
agcucuuccuugacaaacagcc

SEQ ID NO: 11151 - RNA, 22 nt, Artificial Sequence
  Guide Sequence
aggaccauucguuggggaauug

SEQ ID NO: 11152 - RNA, 22 nt, Artificial Sequence
  Guide Sequence
aggaggggccugaggggcuggg

SEQ ID NO: 11153 - RNA, 22 nt, Artificial Sequence
  Guide Sequence
aggccccgugcuguuugcuuuu

SEQ ID NO: 11154 - RNA, 22 nt, Artificial Sequence
  Guide Sequence
aggcuaaugaaagcagauaguc

SEQ ID NO: 11155 - RNA, 22 nt, Artificial Sequence
  Guide Sequence
agggaaacugaaaacacacacu

SEQ ID NO: 11156 - RNA, 22 nt, Artificial Sequence
  Guide Sequence
agggagauuuaagggucuugau

SEQ ID NO: 11157 - RNA, 22 nt, Artificial Sequence
  Guide Sequence
agggccaacuucuuuagugguu

SEQ ID NO: 11158 - RNA, 22 nt, Artificial Sequence
  Guide Sequence
aggggccugaggggcugggcag

SEQ ID NO: 11159 - RNA, 22 nt, Artificial Sequence
  Guide Sequence
aggggcugggcagacuaugcag

SEQ ID NO: 11160 - RNA, 22 nt, Artificial Sequence
  Guide Sequence
agggucuugaucaaggucucag

SEQ ID NO: 11161 - RNA, 22 nt, Artificial Sequence
  Guide Sequence
agguaaacaauuccuugugugu

SEQ ID NO: 11162 - RNA, 22 nt, Artificial Sequence
  Guide Sequence
aggucggggugaggccccgugc

SEQ ID NO: 11163 - RNA, 22 nt, Artificial Sequence
  Guide Sequence
aggucucagguaaacaauuccu

SEQ ID NO: 11164 - RNA, 22 nt, Artificial Sequence
  Guide Sequence
agucagccagagaggucggggu

SEQ ID NO: 11165 - RNA, 22 nt, Artificial Sequence
  Guide Sequence
agucgcuaaauuacccuccugg

SEQ ID NO: 11166 - RNA, 22 nt, Artificial Sequence
  Guide Sequence
agugugagagggagauuuaagg

SEQ ID NO: 11167 - RNA, 22 nt, Artificial Sequence
  Guide Sequence
aguuaacgagcaggcuaaugaa

SEQ ID NO: 11168 - RNA, 22 nt, Artificial Sequence
  Guide Sequence
auaagaagggaaacugaaaaca

SEQ ID NO: 11169 - RNA, 22 nt, Artificial Sequence
  Guide Sequence
auaggaggggccugaggggcug

SEQ ID NO: 11170 - RNA, 22 nt, Artificial Sequence
  Guide Sequence
auagucgcuaaauuacccuccu

SEQ ID NO: 11171 - RNA, 22 nt, Artificial Sequence
  Guide Sequence
aucaaggucucagguaaacaau

SEQ ID NO: 11172 - RNA, 22 nt, Artificial Sequence
  Guide Sequence
auccccuccugccugccucuga

SEQ ID NO: 11173 - RNA, 22 nt, Artificial Sequence
  Guide Sequence
aucuccagggccaacuucuuua

SEQ ID NO: 11174 - RNA, 22 nt, Artificial Sequence
  Guide Sequence
augaaagcagauagucgcuaaa

SEQ ID NO: 11175 - RNA, 22 nt, Artificial Sequence
  Guide Sequence
augaccgggccucaaggcuacu

SEQ ID NO: 11176 - RNA, 22 nt, Artificial Sequence
  Guide Sequence
augcaggaccauucguugggga

SEQ ID NO: 11177 - RNA, 22 nt, Artificial Sequence
  Guide Sequence
auuacccuccuggagccugggc

SEQ ID NO: 11178 - RNA, 22 nt, Artificial Sequence
  Guide Sequence
auuccuuguguguaaacagcua

SEQ ID NO: 11179 - RNA, 22 nt, Artificial Sequence
  Guide Sequence
auucguuggggaauugaugacc

SEQ ID NO: 11180 - RNA, 22 nt, Artificial Sequence
  Guide Sequence
auugaugaccgggccucaaggc

SEQ ID NO: 11181 - RNA, 22 nt, Artificial Sequence
  Guide Sequence
auuuaagggucuugaucaaggu

SEQ ID NO: 11182 - RNA, 22 nt, Artificial Sequence
  Guide Sequence
caaacagcccugcacccugggu

SEQ ID NO: 11183 - RNA, 22 nt, Artificial Sequence
  Guide Sequence
caaggcuacuccaucaaugcag

SEQ ID NO: 11184 - RNA, 22 nt, Artificial Sequence
  Guide Sequence
caaggucucagguaaacaauuc

SEQ ID NO: 11185 - RNA, 22 nt, Artificial Sequence
  Guide Sequence
caauuccuuguguguaaacagc

SEQ ID NO: 11186 - RNA, 22 nt, Artificial Sequence
  Guide Sequence
cacacacuaacacccagaaacu

SEQ ID NO: 11187 - RNA, 22 nt, Artificial Sequence
  Guide Sequence
cacacuaacacccagaaacuga

SEQ ID NO: 11188 - RNA, 22 nt, Artificial Sequence
  Guide Sequence
caccaucuccagggccaacuuc

SEQ ID NO: 11189 - RNA, 22 nt, Artificial Sequence
  Guide Sequence
cacccagaaacugacagccccc

SEQ ID NO: 11190 - RNA, 22 nt, Artificial Sequence
  Guide Sequence
cacccugggugggcacucccac

SEQ ID NO: 11191 - RNA, 22 nt, Artificial Sequence
  Guide Sequence
cacuaacacccagaaacugaca

SEQ ID NO: 11192 - RNA, 22 nt, Artificial Sequence
  Guide Sequence
cacucccaccaucuccagggcc

SEQ ID NO: 11193 - RNA, 22 nt, Artificial Sequence
  Guide Sequence
cacuguuuuauaagaagggaaa

SEQ ID NO: 11194 - RNA, 22 nt, Artificial Sequence
  Guide Sequence
cagaaacugacagcccccucuc

SEQ ID NO: 11195 - RNA, 22 nt, Artificial Sequence
  Guide Sequence
cagaauccccuccugccugccu

SEQ ID NO: 11196 - RNA, 22 nt, Artificial Sequence
  Guide Sequence
cagacuaugcaggaccauucgu

SEQ ID NO: 11197 - RNA, 22 nt, Artificial Sequence
  Guide Sequence
cagagaggucggggugaggccc

SEQ ID NO: 11198 - RNA, 22 nt, Artificial Sequence
  Guide Sequence
cagauagucgcuaaauuacccu

SEQ ID NO: 11199 - RNA, 22 nt, Artificial Sequence
  Guide Sequence
cagccagagaggucggggugag

SEQ ID NO: 11200 - RNA, 22 nt, Artificial Sequence
  Guide Sequence
cagcccccucuccucacccacc

SEQ ID NO: 11201 - RNA, 22 nt, Artificial Sequence
  Guide Sequence
cagcccugcacccugggugggc

SEQ ID NO: 11202 - RNA, 22 nt, Artificial Sequence
  Guide Sequence
cagcuaauucucacuguuuuau

SEQ ID NO: 11203 - RNA, 22 nt, Artificial Sequence
  Guide Sequence
caggaccauucguuggggaauu

SEQ ID NO: 11204 - RNA, 22 nt, Artificial Sequence
  Guide Sequence
caggcuaaugaaagcagauagu

SEQ ID NO: 11205 - RNA, 22 nt, Artificial Sequence
  Guide Sequence
cagggccaacuucuuuaguggu

SEQ ID NO: 11206 - RNA, 22 nt, Artificial Sequence
  Guide Sequence
cagguaaacaauuccuugugug

SEQ ID NO: 11207 - RNA, 22 nt, Artificial Sequence
  Guide Sequence
caucuccagggccaacuucuuu

SEQ ID NO: 11208 - RNA, 22 nt, Artificial Sequence
  Guide Sequence
cauucguuggggaauugaugac

SEQ ID NO: 11209 - RNA, 22 nt, Artificial Sequence
  Guide Sequence
ccaccaucuccagggccaacuu

SEQ ID NO: 11210 - RNA, 22 nt, Artificial Sequence
  Guide Sequence
ccagaaacugacagcccccucu

SEQ ID NO: 11211 - RNA, 22 nt, Artificial Sequence
  Guide Sequence
ccagagaggucggggugaggcc

SEQ ID NO: 11212 - RNA, 22 nt, Artificial Sequence
  Guide Sequence
ccagggccaacuucuuuagugg

SEQ ID NO: 11213 - RNA, 22 nt, Artificial Sequence
  Guide Sequence
ccaucuccagggccaacuucuu

SEQ ID NO: 11214 - RNA, 22 nt, Artificial Sequence
  Guide Sequence
ccauucguuggggaauugauga

SEQ ID NO: 11215 - RNA, 22 nt, Artificial Sequence
  Guide Sequence
cccaccaucuccagggccaacu

SEQ ID NO: 11216 - RNA, 22 nt, Artificial Sequence
  Guide Sequence
cccagaaacugacagcccccuc

SEQ ID NO: 11217 - RNA, 22 nt, Artificial Sequence
  Guide Sequence
ccccccggcuagcucuuccuug

SEQ ID NO: 11218 - RNA, 22 nt, Artificial Sequence
  Guide Sequence
cccccggcuagcucuuccuuga

SEQ ID NO: 11219 - RNA, 22 nt, Artificial Sequence
  Guide Sequence
cccccucuccucacccaccccc

SEQ ID NO: 11220 - RNA, 22 nt, Artificial Sequence
  Guide Sequence
ccccggcuagcucuuccuugac

SEQ ID NO: 11221 - RNA, 22 nt, Artificial Sequence
  Guide Sequence
ccccgugcuguuugcuuuucug

SEQ ID NO: 11222 - RNA, 22 nt, Artificial Sequence
  Guide Sequence
ccccuccugccugccucugaua

SEQ ID NO: 11223 - RNA, 22 nt, Artificial Sequence
  Guide Sequence
ccccucuccucacccacccccc

SEQ ID NO: 11224 - RNA, 22 nt, Artificial Sequence
  Guide Sequence
cccggcuagcucuuccuugaca

SEQ ID NO: 11225 - RNA, 22 nt, Artificial Sequence
  Guide Sequence
cccgugcuguuugcuuuucugc

SEQ ID NO: 11226 - RNA, 22 nt, Artificial Sequence
  Guide Sequence
cccuccugccugccucugauag

SEQ ID NO: 11227 - RNA, 22 nt, Artificial Sequence
  Guide Sequence
cccuccuggagccugggcuagu

SEQ ID NO: 11228 - RNA, 22 nt, Artificial Sequence
  Guide Sequence
cccugcacccugggugggcacu

SEQ ID NO: 11229 - RNA, 22 nt, Artificial Sequence
  Guide Sequence
cccugggugggcacucccacca

SEQ ID NO: 11230 - RNA, 22 nt, Artificial Sequence
  Guide Sequence
ccggcuagcucuuccuugacaa

SEQ ID NO: 11231 - RNA, 22 nt, Artificial Sequence
  Guide Sequence
ccgggccucaaggcuacuccau

SEQ ID NO: 11232 - RNA, 22 nt, Artificial Sequence
  Guide Sequence
ccgugcuguuugcuuuucugca

SEQ ID NO: 11233 - RNA, 22 nt, Artificial Sequence
  Guide Sequence
ccucaaggcuacuccaucaaug

SEQ ID NO: 11234 - RNA, 22 nt, Artificial Sequence
  Guide Sequence
ccuccugccugccucugauagg

SEQ ID NO: 11235 - RNA, 22 nt, Artificial Sequence
  Guide Sequence
ccuccuggagccugggcuaguc

SEQ ID NO: 11236 - RNA, 22 nt, Artificial Sequence
  Guide Sequence
ccucugauaggaggggccugag

SEQ ID NO: 11237 - RNA, 22 nt, Artificial Sequence
  Guide Sequence
ccugaggggcugggcagacuau

SEQ ID NO: 11238 - RNA, 22 nt, Artificial Sequence
  Guide Sequence
ccugcacccugggugggcacuc

SEQ ID NO: 11239 - RNA, 22 nt, Artificial Sequence
  Guide Sequence
ccugccucugauaggaggggcc

SEQ ID NO: 11240 - RNA, 22 nt, Artificial Sequence
  Guide Sequence
ccugccugccucugauaggagg

SEQ ID NO: 11241 - RNA, 22 nt, Artificial Sequence
  Guide Sequence
ccuggagccugggcuagucagc

SEQ ID NO: 11242 - RNA, 22 nt, Artificial Sequence
  Guide Sequence
ccugggcuagucagccagagag

SEQ ID NO: 11243 - RNA, 22 nt, Artificial Sequence
  Guide Sequence
ccugggugggcacucccaccau

SEQ ID NO: 11244 - RNA, 22 nt, Artificial Sequence
  Guide Sequence
ccuugacaaacagcccugcacc

SEQ ID NO: 11245 - RNA, 22 nt, Artificial Sequence
  Guide Sequence
ccuuguguguaaacagcuaauu

SEQ ID NO: 11246 - RNA, 22 nt, Artificial Sequence
  Guide Sequence
cgagcaggcuaaugaaagcaga

SEQ ID NO: 11247 - RNA, 22 nt, Artificial Sequence
  Guide Sequence
cgcuaaauuacccuccuggagc

SEQ ID NO: 11248 - RNA, 22 nt, Artificial Sequence
  Guide Sequence
cggcuagcucuuccuugacaaa

SEQ ID NO: 11249 - RNA, 22 nt, Artificial Sequence
  Guide Sequence
cgggccucaaggcuacuccauc

SEQ ID NO: 11250 - RNA, 22 nt, Artificial Sequence
  Guide Sequence
cggggugaggccccgugcuguu

SEQ ID NO: 11251 - RNA, 22 nt, Artificial Sequence
  Guide Sequence
cgugcuguuugcuuuucugcag

SEQ ID NO: 11252 - RNA, 22 nt, Artificial Sequence
  Guide Sequence
cguuggggaauugaugaccggg

SEQ ID NO: 11253 - RNA, 22 nt, Artificial Sequence
  Guide Sequence
cuaaauuacccuccuggagccu

SEQ ID NO: 11254 - RNA, 22 nt, Artificial Sequence
  Guide Sequence
cuaacacccagaaacugacagc

SEQ ID NO: 11255 - RNA, 22 nt, Artificial Sequence
  Guide Sequence
cuaaugaaagcagauagucgcu

SEQ ID NO: 11256 - RNA, 22 nt, Artificial Sequence
  Guide Sequence
cuagcucuuccuugacaaacag

SEQ ID NO: 11257 - RNA, 22 nt, Artificial Sequence
  Guide Sequence
cuagucagccagagaggucggg

SEQ ID NO: 11258 - RNA, 22 nt, Artificial Sequence
  Guide Sequence
cuaugcaggaccauucguuggg

SEQ ID NO: 11259 - RNA, 22 nt, Artificial Sequence
  Guide Sequence
cucaaggcuacuccaucaaugc

SEQ ID NO: 11260 - RNA, 22 nt, Artificial Sequence
  Guide Sequence
cucacuguuuuauaagaaggga

SEQ ID NO: 11261 - RNA, 22 nt, Artificial Sequence
  Guide Sequence
cucagguaaacaauuccuugug

SEQ ID NO: 11262 - RNA, 22 nt, Artificial Sequence
  Guide Sequence
cuccagggccaacuucuuuagu

SEQ ID NO: 11263 - RNA, 22 nt, Artificial Sequence
  Guide Sequence
cucccaccaucuccagggccaa

SEQ ID NO: 11264 - RNA, 22 nt, Artificial Sequence
  Guide Sequence
cuccugccugccucugauagga

SEQ ID NO: 11265 - RNA, 22 nt, Artificial Sequence
  Guide Sequence
cuccuggagccugggcuaguca

SEQ ID NO: 11266 - RNA, 22 nt, Artificial Sequence
  Guide Sequence
cucugauaggaggggccugagg

SEQ ID NO: 11267 - RNA, 22 nt, Artificial Sequence
  Guide Sequence
cucuuccuugacaaacagcccu

SEQ ID NO: 11268 - RNA, 22 nt, Artificial Sequence
  Guide Sequence
cugaaaacacacacuaacaccc

SEQ ID NO: 11269 - RNA, 22 nt, Artificial Sequence
  Guide Sequence
cugacagcccccucuccucacc

SEQ ID NO: 11270 - RNA, 22 nt, Artificial Sequence
  Guide Sequence
cugaggggcugggcagacuaug

SEQ ID NO: 11271 - RNA, 22 nt, Artificial Sequence
  Guide Sequence
cugauaggaggggccugagggg

SEQ ID NO: 11272 - RNA, 22 nt, Artificial Sequence
  Guide Sequence
cugcacccugggugggcacucc

SEQ ID NO: 11273 - RNA, 22 nt, Artificial Sequence
  Guide Sequence
cugcagaauccccuccugccug

SEQ ID NO: 11274 - RNA, 22 nt, Artificial Sequence
  Guide Sequence
cugccucugauaggaggggccu

SEQ ID NO: 11275 - RNA, 22 nt, Artificial Sequence
  Guide Sequence
cugccugccucugauaggaggg

SEQ ID NO: 11276 - RNA, 22 nt, Artificial Sequence
  Guide Sequence
cuggagccugggcuagucagcc

SEQ ID NO: 11277 - RNA, 22 nt, Artificial Sequence
  Guide Sequence
cugggcagacuaugcaggacca

SEQ ID NO: 11278 - RNA, 22 nt, Artificial Sequence
  Guide Sequence
cugggcuagucagccagagagg

SEQ ID NO: 11279 - RNA, 22 nt, Artificial Sequence
  Guide Sequence
cuggggguagugugagagggag

SEQ ID NO: 11280 - RNA, 22 nt, Artificial Sequence
  Guide Sequence
cugggugggcacucccaccauc

SEQ ID NO: 11281 - RNA, 22 nt, Artificial Sequence
  Guide Sequence
cuguuugcuuuucugcagaauc

SEQ ID NO: 11282 - RNA, 22 nt, Artificial Sequence
  Guide Sequence
cuguuuuauaagaagggaaacu

SEQ ID NO: 11283 - RNA, 22 nt, Artificial Sequence
  Guide Sequence
cuuccuugacaaacagcccugc

SEQ ID NO: 11284 - RNA, 22 nt, Artificial Sequence
  Guide Sequence
cuugacaaacagcccugcaccc

SEQ ID NO: 11285 - RNA, 22 nt, Artificial Sequence
  Guide Sequence
cuugaucaaggucucagguaaa

SEQ ID NO: 11286 - RNA, 22 nt, Artificial Sequence
  Guide Sequence
cuuguguguaaacagcuaauuc

SEQ ID NO: 11287 - RNA, 22 nt, Artificial Sequence
  Guide Sequence
cuuuucugcagaauccccuccu

SEQ ID NO: 11288 - RNA, 22 nt, Artificial Sequence
  Guide Sequence
gaaaacacacacuaacacccag

SEQ ID NO: 11289 - RNA, 22 nt, Artificial Sequence
  Guide Sequence
gaaaaguuaacgagcaggcuaa

SEQ ID NO: 11290 - RNA, 22 nt, Artificial Sequence
  Guide Sequence
gaaacugaaaacacacacuaac

SEQ ID NO: 11291 - RNA, 22 nt, Artificial Sequence
  Guide Sequence
gaaacugacagcccccucuccu

SEQ ID NO: 11292 - RNA, 22 nt, Artificial Sequence
  Guide Sequence
gaaagcagauagucgcuaaauu

SEQ ID NO: 11293 - RNA, 22 nt, Artificial Sequence
  Guide Sequence
gaagggaaacugaaaacacaca

SEQ ID NO: 11294 - RNA, 22 nt, Artificial Sequence
  Guide Sequence
gaauccccuccugccugccucu

SEQ ID NO: 11295 - RNA, 22 nt, Artificial Sequence
  Guide Sequence
gaauugaugaccgggccucaag

SEQ ID NO: 11296 - RNA, 22 nt, Artificial Sequence
  Guide Sequence
gacaaacagcccugcacccugg

SEQ ID NO: 11297 - RNA, 22 nt, Artificial Sequence
  Guide Sequence
gacagcccccucuccucaccca

SEQ ID NO: 11298 - RNA, 22 nt, Artificial Sequence
  Guide Sequence
gaccauucguuggggaauugau

SEQ ID NO: 11299 - RNA, 22 nt, Artificial Sequence
  Guide Sequence
gaccgggccucaaggcuacucc

SEQ ID NO: 11300 - RNA, 22 nt, Artificial Sequence
  Guide Sequence
gacuaugcaggaccauucguug

SEQ ID NO: 11301 - RNA, 22 nt, Artificial Sequence
  Guide Sequence
gagagggagauuuaagggucuu

SEQ ID NO: 11302 - RNA, 22 nt, Artificial Sequence
  Guide Sequence
gagaggucggggugaggccccg

SEQ ID NO: 11303 - RNA, 22 nt, Artificial Sequence
  Guide Sequence
gagauuuaagggucuugaucaa

SEQ ID NO: 11304 - RNA, 22 nt, Artificial Sequence
  Guide Sequence
gagcaggcuaaugaaagcagau

SEQ ID NO: 11305 - RNA, 22 nt, Artificial Sequence
  Guide Sequence
gagccugggcuagucagccaga

SEQ ID NO: 11306 - RNA, 22 nt, Artificial Sequence
  Guide Sequence
gaggccccgugcuguuugcuuu

SEQ ID NO: 11307 - RNA, 22 nt, Artificial Sequence
  Guide Sequence
gagggagauuuaagggucuuga

SEQ ID NO: 11308 - RNA, 22 nt, Artificial Sequence
  Guide Sequence
gaggggccugaggggcugggca

SEQ ID NO: 11309 - RNA, 22 nt, Artificial Sequence
  Guide Sequence
gaggggcugggcagacuaugca

SEQ ID NO: 11310 - RNA, 22 nt, Artificial Sequence
  Guide Sequence
gaggucggggugaggccccgug

SEQ ID NO: 11311 - RNA, 22 nt, Artificial Sequence
  Guide Sequence
gauaggaggggccugaggggcu

SEQ ID NO: 11312 - RNA, 22 nt, Artificial Sequence
  Guide Sequence
gauagucgcuaaauuacccucc

SEQ ID NO: 11313 - RNA, 22 nt, Artificial Sequence
  Guide Sequence
gaucaaggucucagguaaacaa

SEQ ID NO: 11314 - RNA, 22 nt, Artificial Sequence
  Guide Sequence
gaugaccgggccucaaggcuac

SEQ ID NO: 11315 - RNA, 22 nt, Artificial Sequence
  Guide Sequence
gauuuaagggucuugaucaagg

SEQ ID NO: 11316 - RNA, 22 nt, Artificial Sequence
  Guide Sequence
gcacccugggugggcacuccca

SEQ ID NO: 11317 - RNA, 22 nt, Artificial Sequence
  Guide Sequence
gcacucccaccaucuccagggc

SEQ ID NO: 11318 - RNA, 22 nt, Artificial Sequence
  Guide Sequence
gcagaauccccuccugccugcc

SEQ ID NO: 11319 - RNA, 22 nt, Artificial Sequence
  Guide Sequence
gcagacuaugcaggaccauucg

SEQ ID NO: 11320 - RNA, 22 nt, Artificial Sequence
  Guide Sequence
gcagauagucgcuaaauuaccc

SEQ ID NO: 11321 - RNA, 22 nt, Artificial Sequence
  Guide Sequence
gcaggaccauucguuggggaau

SEQ ID NO: 11322 - RNA, 22 nt, Artificial Sequence
  Guide Sequence
gcaggcuaaugaaagcagauag

SEQ ID NO: 11323 - RNA, 22 nt, Artificial Sequence
  Guide Sequence
gccaacuucuuuagugguuacu

SEQ ID NO: 11324 - RNA, 22 nt, Artificial Sequence
  Guide Sequence
gccagagaggucggggugaggc

SEQ ID NO: 11325 - RNA, 22 nt, Artificial Sequence
  Guide Sequence
gcccccucuccucacccacccc

SEQ ID NO: 11326 - RNA, 22 nt, Artificial Sequence
  Guide Sequence
gccccgugcuguuugcuuuucu

SEQ ID NO: 11327 - RNA, 22 nt, Artificial Sequence
  Guide Sequence
gcccugcacccugggugggcac

SEQ ID NO: 11328 - RNA, 22 nt, Artificial Sequence
  Guide Sequence
gccucaaggcuacuccaucaau

SEQ ID NO: 11329 - RNA, 22 nt, Artificial Sequence
  Guide Sequence
gccucugauaggaggggccuga

SEQ ID NO: 11330 - RNA, 22 nt, Artificial Sequence
  Guide Sequence
gccugaggggcugggcagacua

SEQ ID NO: 11331 - RNA, 22 nt, Artificial Sequence
  Guide Sequence
gccugccucugauaggaggggc

SEQ ID NO: 11332 - RNA, 22 nt, Artificial Sequence
  Guide Sequence
gccugggcuagucagccagaga

SEQ ID NO: 11333 - RNA, 22 nt, Artificial Sequence
  Guide Sequence
gcuaaauuacccuccuggagcc

SEQ ID NO: 11334 - RNA, 22 nt, Artificial Sequence
  Guide Sequence
gcuaaugaaagcagauagucgc

SEQ ID NO: 11335 - RNA, 22 nt, Artificial Sequence
  Guide Sequence
gcuagcucuuccuugacaaaca

SEQ ID NO: 11336 - RNA, 22 nt, Artificial Sequence
  Guide Sequence
gcuagucagccagagaggucgg

SEQ ID NO: 11337 - RNA, 22 nt, Artificial Sequence
  Guide Sequence
gcucuuccuugacaaacagccc

SEQ ID NO: 11338 - RNA, 22 nt, Artificial Sequence
  Guide Sequence
gcugggcagacuaugcaggacc

SEQ ID NO: 11339 - RNA, 22 nt, Artificial Sequence
  Guide Sequence
gcuguuugcuuuucugcagaau

SEQ ID NO: 11340 - RNA, 22 nt, Artificial Sequence
  Guide Sequence
gcuuuucugcagaauccccucc

SEQ ID NO: 11341 - RNA, 22 nt, Artificial Sequence
  Guide Sequence
ggaaaaguuaacgagcaggcua

SEQ ID NO: 11342 - RNA, 22 nt, Artificial Sequence
  Guide Sequence
ggaaacugaaaacacacacuaa

SEQ ID NO: 11343 - RNA, 22 nt, Artificial Sequence
  Guide Sequence
ggaauugaugaccgggccucaa

SEQ ID NO: 11344 - RNA, 22 nt, Artificial Sequence
  Guide Sequence
ggaccauucguuggggaauuga

SEQ ID NO: 11345 - RNA, 22 nt, Artificial Sequence
  Guide Sequence
ggagauuuaagggucuugauca

SEQ ID NO: 11346 - RNA, 22 nt, Artificial Sequence
  Guide Sequence
ggagccugggcuagucagccag

SEQ ID NO: 11347 - RNA, 22 nt, Artificial Sequence
  Guide Sequence
ggcacucccaccaucuccaggg

SEQ ID NO: 11348 - RNA, 22 nt, Artificial Sequence
  Guide Sequence
ggcagacuaugcaggaccauuc

SEQ ID NO: 11349 - RNA, 22 nt, Artificial Sequence
  Guide Sequence
ggccaacuucuuuagugguuac

SEQ ID NO: 11350 - RNA, 22 nt, Artificial Sequence
  Guide Sequence
ggccccgugcuguuugcuuuuc

SEQ ID NO: 11351 - RNA, 22 nt, Artificial Sequence
  Guide Sequence
ggccucaaggcuacuccaucaa

SEQ ID NO: 11352 - RNA, 22 nt, Artificial Sequence
  Guide Sequence
ggccugaggggcugggcagacu

SEQ ID NO: 11353 - RNA, 22 nt, Artificial Sequence
  Guide Sequence
ggcuaaugaaagcagauagucg

SEQ ID NO: 11354 - RNA, 22 nt, Artificial Sequence
  Guide Sequence
ggcuagcucuuccuugacaaac

SEQ ID NO: 11355 - RNA, 22 nt, Artificial Sequence
  Guide Sequence
ggcuagucagccagagaggucg

SEQ ID NO: 11356 - RNA, 22 nt, Artificial Sequence
  Guide Sequence
ggcugggcagacuaugcaggac

SEQ ID NO: 11357 - RNA, 22 nt, Artificial Sequence
  Guide Sequence
gggaaaaguuaacgagcaggcu

SEQ ID NO: 11358 - RNA, 22 nt, Artificial Sequence
  Guide Sequence
gggaaacugaaaacacacacua

SEQ ID NO: 11359 - RNA, 22 nt, Artificial Sequence
  Guide Sequence
gggaauugaugaccgggccuca

SEQ ID NO: 11360 - RNA, 22 nt, Artificial Sequence
  Guide Sequence
gggagauuuaagggucuugauc

SEQ ID NO: 11361 - RNA, 22 nt, Artificial Sequence
  Guide Sequence
gggcacucccaccaucuccagg

SEQ ID NO: 11362 - RNA, 22 nt, Artificial Sequence
  Guide Sequence
gggcagacuaugcaggaccauu

SEQ ID NO: 11363 - RNA, 22 nt, Artificial Sequence
  Guide Sequence
gggccaacuucuuuagugguua

SEQ ID NO: 11364 - RNA, 22 nt, Artificial Sequence
  Guide Sequence
gggccucaaggcuacuccauca

SEQ ID NO: 11365 - RNA, 22 nt, Artificial Sequence
  Guide Sequence
gggccugaggggcugggcagac

SEQ ID NO: 11366 - RNA, 22 nt, Artificial Sequence
  Guide Sequence
gggcuagucagccagagagguc

SEQ ID NO: 11367 - RNA, 22 nt, Artificial Sequence
  Guide Sequence
gggcugggcagacuaugcagga

SEQ ID NO: 11368 - RNA, 22 nt, Artificial Sequence
  Guide Sequence
ggggaauugaugaccgggccuc

SEQ ID NO: 11369 - RNA, 22 nt, Artificial Sequence
  Guide Sequence
ggggccugaggggcugggcaga

SEQ ID NO: 11370 - RNA, 22 nt, Artificial Sequence
  Guide Sequence
ggggcugggcagacuaugcagg

SEQ ID NO: 11371 - RNA, 22 nt, Artificial Sequence
  Guide Sequence
ggggguagugugagagggagau

SEQ ID NO: 11372 - RNA, 22 nt, Artificial Sequence
  Guide Sequence
gggguagugugagagggagauu

SEQ ID NO: 11373 - RNA, 22 nt, Artificial Sequence
  Guide Sequence
ggggugaggccccgugcuguuu

SEQ ID NO: 11374 - RNA, 22 nt, Artificial Sequence
  Guide Sequence
ggguagugugagagggagauuu

SEQ ID NO: 11375 - RNA, 22 nt, Artificial Sequence
  Guide Sequence
gggucuugaucaaggucucagg

SEQ ID NO: 11376 - RNA, 22 nt, Artificial Sequence
  Guide Sequence
gggugaggccccgugcuguuug

SEQ ID NO: 11377 - RNA, 22 nt, Artificial Sequence
  Guide Sequence
gggugggcacucccaccaucuc

SEQ ID NO: 11378 - RNA, 22 nt, Artificial Sequence
  Guide Sequence
gguaaacaauuccuugugugua

SEQ ID NO: 11379 - RNA, 22 nt, Artificial Sequence
  Guide Sequence
gguagugugagagggagauuua

SEQ ID NO: 11380 - RNA, 22 nt, Artificial Sequence
  Guide Sequence
ggucggggugaggccccgugcu

SEQ ID NO: 11381 - RNA, 22 nt, Artificial Sequence
  Guide Sequence
ggucucagguaaacaauuccuu

SEQ ID NO: 11382 - RNA, 22 nt, Artificial Sequence
  Guide Sequence
ggucuugaucaaggucucaggu

SEQ ID NO: 11383 - RNA, 22 nt, Artificial Sequence
  Guide Sequence
ggugaggccccgugcuguuugc

SEQ ID NO: 11384 - RNA, 22 nt, Artificial Sequence
  Guide Sequence
ggugggcacucccaccaucucc

SEQ ID NO: 11385 - RNA, 22 nt, Artificial Sequence
  Guide Sequence
guaaacaauuccuuguguguaa

SEQ ID NO: 11386 - RNA, 22 nt, Artificial Sequence
  Guide Sequence
guaaacagcuaauucucacugu

SEQ ID NO: 11387 - RNA, 22 nt, Artificial Sequence
  Guide Sequence
guagugugagagggagauuuaa

SEQ ID NO: 11388 - RNA, 22 nt, Artificial Sequence
  Guide Sequence
gucagccagagaggucggggug

SEQ ID NO: 11389 - RNA, 22 nt, Artificial Sequence
  Guide Sequence
gucgcuaaauuacccuccugga

SEQ ID NO: 11390 - RNA, 22 nt, Artificial Sequence
  Guide Sequence
gucggggugaggccccgugcug

SEQ ID NO: 11391 - RNA, 22 nt, Artificial Sequence
  Guide Sequence
gucucagguaaacaauuccuug

SEQ ID NO: 11392 - RNA, 22 nt, Artificial Sequence
  Guide Sequence
gucuugaucaaggucucaggua

SEQ ID NO: 11393 - RNA, 22 nt, Artificial Sequence
  Guide Sequence
gugagagggagauuuaaggguc

SEQ ID NO: 11394 - RNA, 22 nt, Artificial Sequence
  Guide Sequence
gugaggccccgugcuguuugcu

SEQ ID NO: 11395 - RNA, 22 nt, Artificial Sequence
  Guide Sequence
gugcuguuugcuuuucugcaga

SEQ ID NO: 11396 - RNA, 22 nt, Artificial Sequence
  Guide Sequence
gugggcacucccaccaucucca

SEQ ID NO: 11397 - RNA, 22 nt, Artificial Sequence
  Guide Sequence
guguaaacagcuaauucucacu

SEQ ID NO: 11398 - RNA, 22 nt, Artificial Sequence
  Guide Sequence
gugugagagggagauuuaaggg

SEQ ID NO: 11399 - RNA, 22 nt, Artificial Sequence
  Guide Sequence
guguguaaacagcuaauucuca

SEQ ID NO: 11400 - RNA, 22 nt, Artificial Sequence
  Guide Sequence
guuaacgagcaggcuaaugaaa

SEQ ID NO: 11401 - RNA, 22 nt, Artificial Sequence
  Guide Sequence
guuggggaauugaugaccgggc

SEQ ID NO: 11402 - RNA, 22 nt, Artificial Sequence
  Guide Sequence
guuugcuuuucugcagaauccc

SEQ ID NO: 11403 - RNA, 22 nt, Artificial Sequence
  Guide Sequence
guuuuauaagaagggaaacuga

SEQ ID NO: 11404 - RNA, 22 nt, Artificial Sequence
  Guide Sequence
uaaacagcuaauucucacuguu

SEQ ID NO: 11405 - RNA, 22 nt, Artificial Sequence
  Guide Sequence
uaaauuacccuccuggagccug

SEQ ID NO: 11406 - RNA, 22 nt, Artificial Sequence
  Guide Sequence
uaacacccagaaacugacagcc

SEQ ID NO: 11407 - RNA, 22 nt, Artificial Sequence
  Guide Sequence
uaacgagcaggcuaaugaaagc

SEQ ID NO: 11408 - RNA, 22 nt, Artificial Sequence
  Guide Sequence
uaagaagggaaacugaaaacac

SEQ ID NO: 11409 - RNA, 22 nt, Artificial Sequence
  Guide Sequence
uaagggucuugaucaaggucuc

SEQ ID NO: 11410 - RNA, 22 nt, Artificial Sequence
  Guide Sequence
uaaugaaagcagauagucgcua

SEQ ID NO: 11411 - RNA, 22 nt, Artificial Sequence
  Guide Sequence
uacccuccuggagccugggcua

SEQ ID NO: 11412 - RNA, 22 nt, Artificial Sequence
  Guide Sequence
uagcucuuccuugacaaacagc

SEQ ID NO: 11413 - RNA, 22 nt, Artificial Sequence
  Guide Sequence
uaggaggggccugaggggcugg

SEQ ID NO: 11414 - RNA, 22 nt, Artificial Sequence
  Guide Sequence
uagucagccagagaggucgggg

SEQ ID NO: 11415 - RNA, 22 nt, Artificial Sequence
  Guide Sequence
uagucgcuaaauuacccuccug

SEQ ID NO: 11416 - RNA, 22 nt, Artificial Sequence
  Guide Sequence
uagugugagagggagauuuaag

SEQ ID NO: 11417 - RNA, 22 nt, Artificial Sequence
  Guide Sequence
uauaagaagggaaacugaaaac

SEQ ID NO: 11418 - RNA, 22 nt, Artificial Sequence
  Guide Sequence
uaugcaggaccauucguugggg

SEQ ID NO: 11419 - RNA, 22 nt, Artificial Sequence
  Guide Sequence
ucaaggcuacuccaucaaugca

SEQ ID NO: 11420 - RNA, 22 nt, Artificial Sequence
  Guide Sequence
ucaaggucucagguaaacaauu

SEQ ID NO: 11421 - RNA, 22 nt, Artificial Sequence
  Guide Sequence
ucacuguuuuauaagaagggaa

SEQ ID NO: 11422 - RNA, 22 nt, Artificial Sequence
  Guide Sequence
ucagccagagaggucgggguga

SEQ ID NO: 11423 - RNA, 22 nt, Artificial Sequence
  Guide Sequence
ucagguaaacaauuccuugugu

SEQ ID NO: 11424 - RNA, 22 nt, Artificial Sequence
  Guide Sequence
uccagggccaacuucuuuagug

SEQ ID NO: 11425 - RNA, 22 nt, Artificial Sequence
  Guide Sequence
ucccaccaucuccagggccaac

SEQ ID NO: 11426 - RNA, 22 nt, Artificial Sequence
  Guide Sequence
uccccuccugccugccucugau

SEQ ID NO: 11427 - RNA, 22 nt, Artificial Sequence
  Guide Sequence
uccugccugccucugauaggag

SEQ ID NO: 11428 - RNA, 22 nt, Artificial Sequence
  Guide Sequence
uccuggagccugggcuagucag

SEQ ID NO: 11429 - RNA, 22 nt, Artificial Sequence
  Guide Sequence
uccuugacaaacagcccugcac

SEQ ID NO: 11430 - RNA, 22 nt, Artificial Sequence
  Guide Sequence
uccuuguguguaaacagcuaau

SEQ ID NO: 11431 - RNA, 22 nt, Artificial Sequence
  Guide Sequence
ucgcuaaauuacccuccuggag

SEQ ID NO: 11432 - RNA, 22 nt, Artificial Sequence
  Guide Sequence
ucggggugaggccccgugcugu

SEQ ID NO: 11433 - RNA, 22 nt, Artificial Sequence
  Guide Sequence
ucguuggggaauugaugaccgg

SEQ ID NO: 11434 - RNA, 22 nt, Artificial Sequence
  Guide Sequence
ucucacuguuuuauaagaaggg

SEQ ID NO: 11435 - RNA, 22 nt, Artificial Sequence
  Guide Sequence
ucucagguaaacaauuccuugu

SEQ ID NO: 11436 - RNA, 22 nt, Artificial Sequence
  Guide Sequence
ucuccagggccaacuucuuuag

SEQ ID NO: 11437 - RNA, 22 nt, Artificial Sequence
  Guide Sequence
ucugauaggaggggccugaggg

SEQ ID NO: 11438 - RNA, 22 nt, Artificial Sequence
  Guide Sequence
ucugcagaauccccuccugccu

SEQ ID NO: 11439 - RNA, 22 nt, Artificial Sequence
  Guide Sequence
ucuuccuugacaaacagcccug

SEQ ID NO: 11440 - RNA, 22 nt, Artificial Sequence
  Guide Sequence
ucuugaucaaggucucagguaa

SEQ ID NO: 11441 - RNA, 22 nt, Artificial Sequence
  Guide Sequence
ugaaaacacacacuaacaccca

SEQ ID NO: 11442 - RNA, 22 nt, Artificial Sequence
  Guide Sequence
ugaaagcagauagucgcuaaau

SEQ ID NO: 11443 - RNA, 22 nt, Artificial Sequence
  Guide Sequence
ugacaaacagcccugcacccug

SEQ ID NO: 11444 - RNA, 22 nt, Artificial Sequence
  Guide Sequence
ugacagcccccucuccucaccc

SEQ ID NO: 11445 - RNA, 22 nt, Artificial Sequence
  Guide Sequence
ugaccgggccucaaggcuacuc

SEQ ID NO: 11446 - RNA, 22 nt, Artificial Sequence
  Guide Sequence
ugagagggagauuuaagggucu

SEQ ID NO: 11447 - RNA, 22 nt, Artificial Sequence
  Guide Sequence
ugaggccccgugcuguuugcuu

SEQ ID NO: 11448 - RNA, 22 nt, Artificial Sequence
  Guide Sequence
ugaggggcugggcagacuaugc

SEQ ID NO: 11449 - RNA, 22 nt, Artificial Sequence
  Guide Sequence
ugauaggaggggccugaggggc

SEQ ID NO: 11450 - RNA, 22 nt, Artificial Sequence
  Guide Sequence
ugaucaaggucucagguaaaca

SEQ ID NO: 11451 - RNA, 22 nt, Artificial Sequence
  Guide Sequence
ugaugaccgggccucaaggcua

SEQ ID NO: 11452 - RNA, 22 nt, Artificial Sequence
  Guide Sequence
ugcacccugggugggcacuccc

SEQ ID NO: 11453 - RNA, 22 nt, Artificial Sequence
  Guide Sequence
ugcagaauccccuccugccugc

SEQ ID NO: 11454 - RNA, 22 nt, Artificial Sequence
  Guide Sequence
ugcaggaccauucguuggggaa

SEQ ID NO: 11455 - RNA, 22 nt, Artificial Sequence
  Guide Sequence
ugccucugauaggaggggccug

SEQ ID NO: 11456 - RNA, 22 nt, Artificial Sequence
  Guide Sequence
ugccugccucugauaggagggg

SEQ ID NO: 11457 - RNA, 22 nt, Artificial Sequence
  Guide Sequence
ugcuguuugcuuuucugcagaa

SEQ ID NO: 11458 - RNA, 22 nt, Artificial Sequence
  Guide Sequence
ugcuuuucugcagaauccccuc

SEQ ID NO: 11459 - RNA, 22 nt, Artificial Sequence
  Guide Sequence
uggagccugggcuagucagcca

SEQ ID NO: 11460 - RNA, 22 nt, Artificial Sequence
  Guide Sequence
ugggaaaaguuaacgagcaggc

SEQ ID NO: 11461 - RNA, 22 nt, Artificial Sequence
  Guide Sequence
ugggcacucccaccaucuccag

SEQ ID NO: 11462 - RNA, 22 nt, Artificial Sequence
  Guide Sequence
ugggcagacuaugcaggaccau

SEQ ID NO: 11463 - RNA, 22 nt, Artificial Sequence
  Guide Sequence
ugggcuagucagccagagaggu

SEQ ID NO: 11464 - RNA, 22 nt, Artificial Sequence
  Guide Sequence
uggggaauugaugaccgggccu

SEQ ID NO: 11465 - RNA, 22 nt, Artificial Sequence
  Guide Sequence
uggggguagugugagagggaga

SEQ ID NO: 11466 - RNA, 22 nt, Artificial Sequence
  Guide Sequence
ugggugggcacucccaccaucu

SEQ ID NO: 11467 - RNA, 22 nt, Artificial Sequence
  Guide Sequence
uguaaacagcuaauucucacug

SEQ ID NO: 11468 - RNA, 22 nt, Artificial Sequence
  Guide Sequence
ugugagagggagauuuaagggu

SEQ ID NO: 11469 - RNA, 22 nt, Artificial Sequence
  Guide Sequence
uguguaaacagcuaauucucac

SEQ ID NO: 11470 - RNA, 22 nt, Artificial Sequence
  Guide Sequence
uguguguaaacagcuaauucuc

SEQ ID NO: 11471 - RNA, 22 nt, Artificial Sequence
  Guide Sequence
uguuugcuuuucugcagaaucc

SEQ ID NO: 11472 - RNA, 22 nt, Artificial Sequence
  Guide Sequence
uguuuuauaagaagggaaacug

SEQ ID NO: 11473 - RNA, 22 nt, Artificial Sequence
  Guide Sequence
uuaacgagcaggcuaaugaaag

SEQ ID NO: 11474 - RNA, 22 nt, Artificial Sequence
  Guide Sequence
uuaagggucuugaucaaggucu

SEQ ID NO: 11475 - RNA, 22 nt, Artificial Sequence
  Guide Sequence
uuacccuccuggagccugggcu

SEQ ID NO: 11476 - RNA, 22 nt, Artificial Sequence
  Guide Sequence
uuccuugacaaacagcccugca

SEQ ID NO: 11477 - RNA, 22 nt, Artificial Sequence
  Guide Sequence
uuccuuguguguaaacagcuaa

SEQ ID NO: 11478 - RNA, 22 nt, Artificial Sequence
  Guide Sequence
uucguuggggaauugaugaccg

SEQ ID NO: 11479 - RNA, 22 nt, Artificial Sequence
  Guide Sequence
uucucacuguuuuauaagaagg

SEQ ID NO: 11480 - RNA, 22 nt, Artificial Sequence
  Guide Sequence
uucugcagaauccccuccugcc

SEQ ID NO: 11481 - RNA, 22 nt, Artificial Sequence
  Guide Sequence
uugacaaacagcccugcacccu

SEQ ID NO: 11482 - RNA, 22 nt, Artificial Sequence
  Guide Sequence
uugaucaaggucucagguaaac

SEQ ID NO: 11483 - RNA, 22 nt, Artificial Sequence
  Guide Sequence
uugaugaccgggccucaaggcu

SEQ ID NO: 11484 - RNA, 22 nt, Artificial Sequence
  Guide Sequence
uugcuuuucugcagaauccccu

SEQ ID NO: 11485 - RNA, 22 nt, Artificial Sequence
  Guide Sequence
uuggggaauugaugaccgggcc

SEQ ID NO: 11486 - RNA, 22 nt, Artificial Sequence
  Guide Sequence
uuguguguaaacagcuaauucu

SEQ ID NO: 11487 - RNA, 22 nt, Artificial Sequence
  Guide Sequence
uuuaagggucuugaucaagguc

SEQ ID NO: 11488 - RNA, 22 nt, Artificial Sequence
  Guide Sequence
uuucugcagaauccccuccugc

SEQ ID NO: 11489 - RNA, 22 nt, Artificial Sequence
  Guide Sequence
uuugcuuuucugcagaaucccc

SEQ ID NO: 11490 - RNA, 22 nt, Artificial Sequence
  Guide Sequence
uuuucugcagaauccccuccug

SEQ ID NO: 11491 - RNA, 20 nt, Artificial Sequence
  Guide Sequence
aaaagccccgaaaaaucaau

SEQ ID NO: 11492 - RNA, 20 nt, Artificial Sequence
  Guide Sequence
aaaagucagacaggacuguc

SEQ ID NO: 11493 - RNA, 20 nt, Artificial Sequence
  Guide Sequence
aaagccaccugccgccagcc

SEQ ID NO: 11494 - RNA, 20 nt, Artificial Sequence
  Guide Sequence
aaagccccgaaaaaucaauu

SEQ ID NO: 11495 - RNA, 20 nt, Artificial Sequence
  Guide Sequence
aaaguaugggcuuuggaaau

SEQ ID NO: 11496 - RNA, 20 nt, Artificial Sequence
  Guide Sequence
aaagucagacaggacugucc

SEQ ID NO: 11497 - RNA, 20 nt, Artificial Sequence
  Guide Sequence
aaagugcugggauuacaggg

SEQ ID NO: 11498 - RNA, 20 nt, Artificial Sequence
  Guide Sequence
aaaugcuugggcagcgacua

SEQ ID NO: 11499 - RNA, 20 nt, Artificial Sequence
  Guide Sequence
aaauuucuaagcagcaccaa

SEQ ID NO: 11500 - RNA, 20 nt, Artificial Sequence
  Guide Sequence
aacaggaaaagucagacagg

SEQ ID NO: 11501 - RNA, 20 nt, Artificial Sequence
  Guide Sequence
aacgagcugggggcaguagu

SEQ ID NO: 11502 - RNA, 20 nt, Artificial Sequence
  Guide Sequence
aagcagcaccaacaggaaaa

SEQ ID NO: 11503 - RNA, 20 nt, Artificial Sequence
  Guide Sequence
aagcauuuagaucaaaagcc

SEQ ID NO: 11504 - RNA, 20 nt, Artificial Sequence
  Guide Sequence
aagccaccugccgccagcca

SEQ ID NO: 11505 - RNA, 20 nt, Artificial Sequence
  Guide Sequence
aagccccgaaaaaucaauug

SEQ ID NO: 11506 - RNA, 20 nt, Artificial Sequence
  Guide Sequence
aagggacccagccccacccc

SEQ ID NO: 11507 - RNA, 20 nt, Artificial Sequence
  Guide Sequence
aagggucaugcaggccccag

SEQ ID NO: 11508 - RNA, 20 nt, Artificial Sequence
  Guide Sequence
aaguaugggcuuuggaaaug

SEQ ID NO: 11509 - RNA, 20 nt, Artificial Sequence
  Guide Sequence
aagucagacaggacuguccu

SEQ ID NO: 11510 - RNA, 20 nt, Artificial Sequence
  Guide Sequence
aagucccacugagggcccua

SEQ ID NO: 11511 - RNA, 20 nt, Artificial Sequence
  Guide Sequence
aagugcugggauuacagggg

SEQ ID NO: 11512 - RNA, 20 nt, Artificial Sequence
  Guide Sequence
aaugcuugggcagcgacuaa

SEQ ID NO: 11513 - RNA, 20 nt, Artificial Sequence
  Guide Sequence
aauuucuaagcagcaccaac

SEQ ID NO: 11514 - RNA, 20 nt, Artificial Sequence
  Guide Sequence
acaccacagccagccugccu

SEQ ID NO: 11515 - RNA, 20 nt, Artificial Sequence
  Guide Sequence
acagccagccugccuccaaa

SEQ ID NO: 11516 - RNA, 20 nt, Artificial Sequence
  Guide Sequence
acaggaaaagucagacagga

SEQ ID NO: 11517 - RNA, 20 nt, Artificial Sequence
  Guide Sequence
acaggacuguccuuucuccu

SEQ ID NO: 11518 - RNA, 20 nt, Artificial Sequence
  Guide Sequence
acaggggugagacaccacag

SEQ ID NO: 11519 - RNA, 20 nt, Artificial Sequence
  Guide Sequence
acagguccuguucucagccc

SEQ ID NO: 11520 - RNA, 20 nt, Artificial Sequence
  Guide Sequence
accaacaggaaaagucagac

SEQ ID NO: 11521 - RNA, 20 nt, Artificial Sequence
  Guide Sequence
accacagccagccugccucc

SEQ ID NO: 11522 - RNA, 20 nt, Artificial Sequence
  Guide Sequence
accagcacccugggcugugc

SEQ ID NO: 11523 - RNA, 20 nt, Artificial Sequence
  Guide Sequence
acccagccccaccccaaacg

SEQ ID NO: 11524 - RNA, 20 nt, Artificial Sequence
  Guide Sequence
accccaccagcacccugggc

SEQ ID NO: 11525 - RNA, 20 nt, Artificial Sequence
  Guide Sequence
acccugggcugugcccucca

SEQ ID NO: 11526 - RNA, 20 nt, Artificial Sequence
  Guide Sequence
accugccgccagccaagucc

SEQ ID NO: 11527 - RNA, 20 nt, Artificial Sequence
  Guide Sequence
acgagcugggggcaguagug

SEQ ID NO: 11528 - RNA, 20 nt, Artificial Sequence
  Guide Sequence
acgggguguuguuugugcaa

SEQ ID NO: 11529 - RNA, 20 nt, Artificial Sequence
  Guide Sequence
acuaagggacccagccccac

SEQ ID NO: 11530 - RNA, 20 nt, Artificial Sequence
  Guide Sequence
acugagggcccuagucaggu

SEQ ID NO: 11531 - RNA, 20 nt, Artificial Sequence
  Guide Sequence
acuguccuuucuccugucuc

SEQ ID NO: 11532 - RNA, 20 nt, Artificial Sequence
  Guide Sequence
agacaccacagccagccugc

SEQ ID NO: 11533 - RNA, 20 nt, Artificial Sequence
  Guide Sequence
agacaggacuguccuuucuc

SEQ ID NO: 11534 - RNA, 20 nt, Artificial Sequence
  Guide Sequence
agagaaggaaauaagucuac

SEQ ID NO: 11535 - RNA, 20 nt, Artificial Sequence
  Guide Sequence
agaucaaaagccccgaaaaa

SEQ ID NO: 11536 - RNA, 20 nt, Artificial Sequence
  Guide Sequence
agcacagguccuguucucag

SEQ ID NO: 11537 - RNA, 20 nt, Artificial Sequence
  Guide Sequence
agcaccaacaggaaaaguca

SEQ ID NO: 11538 - RNA, 20 nt, Artificial Sequence
  Guide Sequence
agcacccugggcugugcccu

SEQ ID NO: 11539 - RNA, 20 nt, Artificial Sequence
  Guide Sequence
agcagcaccaacaggaaaag

SEQ ID NO: 11540 - RNA, 20 nt, Artificial Sequence
  Guide Sequence
agcauuuagaucaaaagccc

SEQ ID NO: 11541 - RNA, 20 nt, Artificial Sequence
  Guide Sequence
agccaagucccacugagggc

SEQ ID NO: 11542 - RNA, 20 nt, Artificial Sequence
  Guide Sequence
agccaccugccgccagccaa

SEQ ID NO: 11543 - RNA, 20 nt, Artificial Sequence
  Guide Sequence
agccagccugccuccaaauu

SEQ ID NO: 11544 - RNA, 20 nt, Artificial Sequence
  Guide Sequence
agccccaccccaaacgcagg

SEQ ID NO: 11545 - RNA, 20 nt, Artificial Sequence
  Guide Sequence
agccccccugggagcugacg

SEQ ID NO: 11546 - RNA, 20 nt, Artificial Sequence
  Guide Sequence
agccccgaaaaaucaauugg

SEQ ID NO: 11547 - RNA, 20 nt, Artificial Sequence
  Guide Sequence
agccccuucccuccuggcug

SEQ ID NO: 11548 - RNA, 20 nt, Artificial Sequence
  Guide Sequence
agcccuccucugaccccacc

SEQ ID NO: 11549 - RNA, 20 nt, Artificial Sequence
  Guide Sequence
agccugccuccaaauuucua

SEQ ID NO: 11550 - RNA, 20 nt, Artificial Sequence
  Guide Sequence
agcgacuaagggacccagcc

SEQ ID NO: 11551 - RNA, 20 nt, Artificial Sequence
  Guide Sequence
agcugacgggguguuguuug

SEQ ID NO: 11552 - RNA, 20 nt, Artificial Sequence
  Guide Sequence
agcugggggcaguaguggga

SEQ ID NO: 11553 - RNA, 20 nt, Artificial Sequence
  Guide Sequence
aggaaaagucagacaggacu

SEQ ID NO: 11554 - RNA, 20 nt, Artificial Sequence
  Guide Sequence
aggacuguccuuucuccugu

SEQ ID NO: 11555 - RNA, 20 nt, Artificial Sequence
  Guide Sequence
aggccccagugagcacaggu

SEQ ID NO: 11556 - RNA, 20 nt, Artificial Sequence
  Guide Sequence
agggaagggucaugcaggcc

SEQ ID NO: 11557 - RNA, 20 nt, Artificial Sequence
  Guide Sequence
agggacccagccccacccca

SEQ ID NO: 11558 - RNA, 20 nt, Artificial Sequence
  Guide Sequence
agggcccuagucaggugcau

SEQ ID NO: 11559 - RNA, 20 nt, Artificial Sequence
  Guide Sequence
aggggugagacaccacagcc

SEQ ID NO: 11560 - RNA, 20 nt, Artificial Sequence
  Guide Sequence
agggucaugcaggccccagu

SEQ ID NO: 11561 - RNA, 20 nt, Artificial Sequence
  Guide Sequence
agguccuguucucagccccu

SEQ ID NO: 11562 - RNA, 20 nt, Artificial Sequence
  Guide Sequence
aggugcauucuaacgagcug

SEQ ID NO: 11563 - RNA, 20 nt, Artificial Sequence
  Guide Sequence
aguagugggagccccccugg

SEQ ID NO: 11564 - RNA, 20 nt, Artificial Sequence
  Guide Sequence
aguaugggcuuuggaaaugc

SEQ ID NO: 11565 - RNA, 20 nt, Artificial Sequence
  Guide Sequence
agucagacaggacuguccuu

SEQ ID NO: 11566 - RNA, 20 nt, Artificial Sequence
  Guide Sequence
agucaggugcauucuaacga

SEQ ID NO: 11567 - RNA, 20 nt, Artificial Sequence
  Guide Sequence
agucccacugagggcccuag

SEQ ID NO: 11568 - RNA, 20 nt, Artificial Sequence
  Guide Sequence
agugagcacagguccuguuc

SEQ ID NO: 11569 - RNA, 20 nt, Artificial Sequence
  Guide Sequence
agugcugggauuacaggggu

SEQ ID NO: 11570 - RNA, 20 nt, Artificial Sequence
  Guide Sequence
agugggagccccccugggag

SEQ ID NO: 11571 - RNA, 20 nt, Artificial Sequence
  Guide Sequence
aucaaaagccccgaaaaauc

SEQ ID NO: 11572 - RNA, 20 nt, Artificial Sequence
  Guide Sequence
augcaggccccagugagcac

SEQ ID NO: 11573 - RNA, 20 nt, Artificial Sequence
  Guide Sequence
augcuugggcagcgacuaag

SEQ ID NO: 11574 - RNA, 20 nt, Artificial Sequence
  Guide Sequence
augggcuuuggaaaugcuug

SEQ ID NO: 11575 - RNA, 20 nt, Artificial Sequence
  Guide Sequence
auuacaggggugagacacca

SEQ ID NO: 11576 - RNA, 20 nt, Artificial Sequence
  Guide Sequence
auucuaacgagcugggggca

SEQ ID NO: 11577 - RNA, 20 nt, Artificial Sequence
  Guide Sequence
auuuagaucaaaagccccga

SEQ ID NO: 11578 - RNA, 20 nt, Artificial Sequence
  Guide Sequence
auuucuaagcagcaccaaca

SEQ ID NO: 11579 - RNA, 20 nt, Artificial Sequence
  Guide Sequence
caaaagccccgaaaaaucaa

SEQ ID NO: 11580 - RNA, 20 nt, Artificial Sequence
  Guide Sequence
caaagugcugggauuacagg

SEQ ID NO: 11581 - RNA, 20 nt, Artificial Sequence
  Guide Sequence
caaauuucuaagcagcacca

SEQ ID NO: 11582 - RNA, 20 nt, Artificial Sequence
  Guide Sequence
caacaggaaaagucagacag

SEQ ID NO: 11583 - RNA, 20 nt, Artificial Sequence
  Guide Sequence
caagcauuuagaucaaaagc

SEQ ID NO: 11584 - RNA, 20 nt, Artificial Sequence
  Guide Sequence
caagucccacugagggcccu

SEQ ID NO: 11585 - RNA, 20 nt, Artificial Sequence
  Guide Sequence
cacagccagccugccuccaa

SEQ ID NO: 11586 - RNA, 20 nt, Artificial Sequence
  Guide Sequence
cacagguccuguucucagcc

SEQ ID NO: 11587 - RNA, 20 nt, Artificial Sequence
  Guide Sequence
caccaacaggaaaagucaga

SEQ ID NO: 11588 - RNA, 20 nt, Artificial Sequence
  Guide Sequence
caccacagccagccugccuc

SEQ ID NO: 11589 - RNA, 20 nt, Artificial Sequence
  Guide Sequence
caccagcacccugggcugug

SEQ ID NO: 11590 - RNA, 20 nt, Artificial Sequence
  Guide Sequence
cacccugggcugugcccucc

SEQ ID NO: 11591 - RNA, 20 nt, Artificial Sequence
  Guide Sequence
caccugccgccagccaaguc

SEQ ID NO: 11592 - RNA, 20 nt, Artificial Sequence
  Guide Sequence
cacugagggcccuagucagg

SEQ ID NO: 11593 - RNA, 20 nt, Artificial Sequence
  Guide Sequence
cagacaggacuguccuuucu

SEQ ID NO: 11594 - RNA, 20 nt, Artificial Sequence
  Guide Sequence
cagagaaggaaauaagucua

SEQ ID NO: 11595 - RNA, 20 nt, Artificial Sequence
  Guide Sequence
cagcaccaacaggaaaaguc

SEQ ID NO: 11596 - RNA, 20 nt, Artificial Sequence
  Guide Sequence
cagcacccugggcugugccc

SEQ ID NO: 11597 - RNA, 20 nt, Artificial Sequence
  Guide Sequence
cagccaagucccacugaggg

SEQ ID NO: 11598 - RNA, 20 nt, Artificial Sequence
  Guide Sequence
cagccagccugccuccaaau

SEQ ID NO: 11599 - RNA, 20 nt, Artificial Sequence
  Guide Sequence
cagccccaccccaaacgcag

SEQ ID NO: 11600 - RNA, 20 nt, Artificial Sequence
  Guide Sequence
cagccccuucccuccuggcu

SEQ ID NO: 11601 - RNA, 20 nt, Artificial Sequence
  Guide Sequence
cagcccuccucugaccccac

SEQ ID NO: 11602 - RNA, 20 nt, Artificial Sequence
  Guide Sequence
cagccugccuccaaauuucu

SEQ ID NO: 11603 - RNA, 20 nt, Artificial Sequence
  Guide Sequence
cagcgacuaagggacccagc

SEQ ID NO: 11604 - RNA, 20 nt, Artificial Sequence
  Guide Sequence
caggaaaagucagacaggac

SEQ ID NO: 11605 - RNA, 20 nt, Artificial Sequence
  Guide Sequence
caggacuguccuuucuccug

SEQ ID NO: 11606 - RNA, 20 nt, Artificial Sequence
  Guide Sequence
caggccccagugagcacagg

SEQ ID NO: 11607 - RNA, 20 nt, Artificial Sequence
  Guide Sequence
caggggugagacaccacagc

SEQ ID NO: 11608 - RNA, 20 nt, Artificial Sequence
  Guide Sequence
cagguccuguucucagcccc

SEQ ID NO: 11609 - RNA, 20 nt, Artificial Sequence
  Guide Sequence
caggugcauucuaacgagcu

SEQ ID NO: 11610 - RNA, 20 nt, Artificial Sequence
  Guide Sequence
caguagugggagccccccug

SEQ ID NO: 11611 - RNA, 20 nt, Artificial Sequence
  Guide Sequence
cagugagcacagguccuguu

SEQ ID NO: 11612 - RNA, 20 nt, Artificial Sequence
  Guide Sequence
caugcaggccccagugagca

SEQ ID NO: 11613 - RNA, 20 nt, Artificial Sequence
  Guide Sequence
cauucuaacgagcugggggc

SEQ ID NO: 11614 - RNA, 20 nt, Artificial Sequence
  Guide Sequence
cauuuagaucaaaagccccg

SEQ ID NO: 11615 - RNA, 20 nt, Artificial Sequence
  Guide Sequence
ccaaagugcugggauuacag

SEQ ID NO: 11616 - RNA, 20 nt, Artificial Sequence
  Guide Sequence
ccaaauuucuaagcagcacc

SEQ ID NO: 11617 - RNA, 20 nt, Artificial Sequence
  Guide Sequence
ccaacaggaaaagucagaca

SEQ ID NO: 11618 - RNA, 20 nt, Artificial Sequence
  Guide Sequence
ccaagucccacugagggccc

SEQ ID NO: 11619 - RNA, 20 nt, Artificial Sequence
  Guide Sequence
ccacagccagccugccucca

SEQ ID NO: 11620 - RNA, 20 nt, Artificial Sequence
  Guide Sequence
ccaccagcacccugggcugu

SEQ ID NO: 11621 - RNA, 20 nt, Artificial Sequence
  Guide Sequence
ccaccugccgccagccaagu

SEQ ID NO: 11622 - RNA, 20 nt, Artificial Sequence
  Guide Sequence
ccacugagggcccuagucag

SEQ ID NO: 11623 - RNA, 20 nt, Artificial Sequence
  Guide Sequence
ccagagaaggaaauaagucu

SEQ ID NO: 11624 - RNA, 20 nt, Artificial Sequence
  Guide Sequence
ccagcacccugggcugugcc

SEQ ID NO: 11625 - RNA, 20 nt, Artificial Sequence
  Guide Sequence
ccagccaagucccacugagg

SEQ ID NO: 11626 - RNA, 20 nt, Artificial Sequence
  Guide Sequence
ccagccccaccccaaacgca

SEQ ID NO: 11627 - RNA, 20 nt, Artificial Sequence
  Guide Sequence
ccagccugccuccaaauuuc

SEQ ID NO: 11628 - RNA, 20 nt, Artificial Sequence
  Guide Sequence
ccagugagcacagguccugu

SEQ ID NO: 11629 - RNA, 20 nt, Artificial Sequence
  Guide Sequence
cccaaagugcugggauuaca

SEQ ID NO: 11630 - RNA, 20 nt, Artificial Sequence
  Guide Sequence
cccaccagcacccugggcug

SEQ ID NO: 11631 - RNA, 20 nt, Artificial Sequence
  Guide Sequence
cccacugagggcccuaguca

SEQ ID NO: 11632 - RNA, 20 nt, Artificial Sequence
  Guide Sequence
cccagccccaccccaaacgc

SEQ ID NO: 11633 - RNA, 20 nt, Artificial Sequence
  Guide Sequence
cccagugagcacagguccug

SEQ ID NO: 11634 - RNA, 20 nt, Artificial Sequence
  Guide Sequence
ccccaccagcacccugggcu

SEQ ID NO: 11635 - RNA, 20 nt, Artificial Sequence
  Guide Sequence
ccccagugagcacagguccu

SEQ ID NO: 11636 - RNA, 20 nt, Artificial Sequence
  Guide Sequence
ccccccugggagcugacggg

SEQ ID NO: 11637 - RNA, 20 nt, Artificial Sequence
  Guide Sequence
cccccugggagcugacgggg

SEQ ID NO: 11638 - RNA, 20 nt, Artificial Sequence
  Guide Sequence
ccccgaaaaaucaauuggga

SEQ ID NO: 11639 - RNA, 20 nt, Artificial Sequence
  Guide Sequence
ccccugggagcugacggggu

SEQ ID NO: 11640 - RNA, 20 nt, Artificial Sequence
  Guide Sequence
ccccuucccuccuggcugug

SEQ ID NO: 11641 - RNA, 20 nt, Artificial Sequence
  Guide Sequence
cccgaaaaaucaauugggaa

SEQ ID NO: 11642 - RNA, 20 nt, Artificial Sequence
  Guide Sequence
cccuagucaggugcauucua

SEQ ID NO: 11643 - RNA, 20 nt, Artificial Sequence
  Guide Sequence
cccuccagagaaggaaauaa

SEQ ID NO: 11644 - RNA, 20 nt, Artificial Sequence
  Guide Sequence
cccuccucugaccccaccag

SEQ ID NO: 11645 - RNA, 20 nt, Artificial Sequence
  Guide Sequence
cccuccuggcugugagccag

SEQ ID NO: 11646 - RNA, 20 nt, Artificial Sequence
  Guide Sequence
cccugggagcugacggggug

SEQ ID NO: 11647 - RNA, 20 nt, Artificial Sequence
  Guide Sequence
cccugggcugugcccuccag

SEQ ID NO: 11648 - RNA, 20 nt, Artificial Sequence
  Guide Sequence
cccuucccuccuggcuguga

SEQ ID NO: 11649 - RNA, 20 nt, Artificial Sequence
  Guide Sequence
ccgaaaaaucaauugggaaa

SEQ ID NO: 11650 - RNA, 20 nt, Artificial Sequence
  Guide Sequence
ccgccagccaagucccacug

SEQ ID NO: 11651 - RNA, 20 nt, Artificial Sequence
  Guide Sequence
ccuagucaggugcauucuaa

SEQ ID NO: 11652 - RNA, 20 nt, Artificial Sequence
  Guide Sequence
ccuccaaauuucuaagcagc

SEQ ID NO: 11653 - RNA, 20 nt, Artificial Sequence
  Guide Sequence
ccuccagagaaggaaauaag

SEQ ID NO: 11654 - RNA, 20 nt, Artificial Sequence
  Guide Sequence
ccuccucugaccccaccagc

SEQ ID NO: 11655 - RNA, 20 nt, Artificial Sequence
  Guide Sequence
ccuccuggcugugagccagg

SEQ ID NO: 11656 - RNA, 20 nt, Artificial Sequence
  Guide Sequence
ccucugaccccaccagcacc

SEQ ID NO: 11657 - RNA, 20 nt, Artificial Sequence
  Guide Sequence
ccugccgccagccaaguccc

SEQ ID NO: 11658 - RNA, 20 nt, Artificial Sequence
  Guide Sequence
ccugccuccaaauuucuaag

SEQ ID NO: 11659 - RNA, 20 nt, Artificial Sequence
  Guide Sequence
ccuggcugugagccaggcuu

SEQ ID NO: 11660 - RNA, 20 nt, Artificial Sequence
  Guide Sequence
ccugggagcugacggggugu

SEQ ID NO: 11661 - RNA, 20 nt, Artificial Sequence
  Guide Sequence
ccugggcugugcccuccaga

SEQ ID NO: 11662 - RNA, 20 nt, Artificial Sequence
  Guide Sequence
ccugucucugggcagcccuc

SEQ ID NO: 11663 - RNA, 20 nt, Artificial Sequence
  Guide Sequence
ccuguucucagccccuuccc

SEQ ID NO: 11664 - RNA, 20 nt, Artificial Sequence
  Guide Sequence
ccuucccuccuggcugugag

SEQ ID NO: 11665 - RNA, 20 nt, Artificial Sequence
  Guide Sequence
ccuuucuccugucucugggc

SEQ ID NO: 11666 - RNA, 20 nt, Artificial Sequence
  Guide Sequence
cgaaaaaucaauugggaaaa

SEQ ID NO: 11667 - RNA, 20 nt, Artificial Sequence
  Guide Sequence
cgacuaagggacccagcccc

SEQ ID NO: 11668 - RNA, 20 nt, Artificial Sequence
  Guide Sequence
cgagcugggggcaguagugg

SEQ ID NO: 11669 - RNA, 20 nt, Artificial Sequence
  Guide Sequence
cgccagccaagucccacuga

SEQ ID NO: 11670 - RNA, 20 nt, Artificial Sequence
  Guide Sequence
cgggguguuguuugugcaag

SEQ ID NO: 11671 - RNA, 20 nt, Artificial Sequence
  Guide Sequence
cuaacgagcugggggcagua

SEQ ID NO: 11672 - RNA, 20 nt, Artificial Sequence
  Guide Sequence
cuaagcagcaccaacaggaa

SEQ ID NO: 11673 - RNA, 20 nt, Artificial Sequence
  Guide Sequence
cuaagggacccagccccacc

SEQ ID NO: 11674 - RNA, 20 nt, Artificial Sequence
  Guide Sequence
cuagucaggugcauucuaac

SEQ ID NO: 11675 - RNA, 20 nt, Artificial Sequence
  Guide Sequence
cucagccccuucccuccugg

SEQ ID NO: 11676 - RNA, 20 nt, Artificial Sequence
  Guide Sequence
cuccaaauuucuaagcagca

SEQ ID NO: 11677 - RNA, 20 nt, Artificial Sequence
  Guide Sequence
cuccagagaaggaaauaagu

SEQ ID NO: 11678 - RNA, 20 nt, Artificial Sequence
  Guide Sequence
cuccucugaccccaccagca

SEQ ID NO: 11679 - RNA, 20 nt, Artificial Sequence
  Guide Sequence
cuccuggcugugagccaggc

SEQ ID NO: 11680 - RNA, 20 nt, Artificial Sequence
  Guide Sequence
cuccugucucugggcagccc

SEQ ID NO: 11681 - RNA, 20 nt, Artificial Sequence
  Guide Sequence
cucugaccccaccagcaccc

SEQ ID NO: 11682 - RNA, 20 nt, Artificial Sequence
  Guide Sequence
cucugggcagcccuccucug

SEQ ID NO: 11683 - RNA, 20 nt, Artificial Sequence
  Guide Sequence
cugaccccaccagcacccug

SEQ ID NO: 11684 - RNA, 20 nt, Artificial Sequence
  Guide Sequence
cugacgggguguuguuugug

SEQ ID NO: 11685 - RNA, 20 nt, Artificial Sequence
  Guide Sequence
cugagggcccuagucaggug

SEQ ID NO: 11686 - RNA, 20 nt, Artificial Sequence
  Guide Sequence
cugccgccagccaaguccca

SEQ ID NO: 11687 - RNA, 20 nt, Artificial Sequence
  Guide Sequence
cugccuccaaauuucuaagc

SEQ ID NO: 11688 - RNA, 20 nt, Artificial Sequence
  Guide Sequence
cuggcugugagccaggcuuc

SEQ ID NO: 11689 - RNA, 20 nt, Artificial Sequence
  Guide Sequence
cugggagcugacgggguguu

SEQ ID NO: 11690 - RNA, 20 nt, Artificial Sequence
  Guide Sequence
cugggauuacaggggugaga

SEQ ID NO: 11691 - RNA, 20 nt, Artificial Sequence
  Guide Sequence
cugggcagcccuccucugac

SEQ ID NO: 11692 - RNA, 20 nt, Artificial Sequence
  Guide Sequence
cugggcugugcccuccagag

SEQ ID NO: 11693 - RNA, 20 nt, Artificial Sequence
  Guide Sequence
cugggggcaguagugggagc

SEQ ID NO: 11694 - RNA, 20 nt, Artificial Sequence
  Guide Sequence
cuguccuuucuccugucucu

SEQ ID NO: 11695 - RNA, 20 nt, Artificial Sequence
  Guide Sequence
cugucucugggcagcccucc

SEQ ID NO: 11696 - RNA, 20 nt, Artificial Sequence
  Guide Sequence
cugugcccuccagagaagga

SEQ ID NO: 11697 - RNA, 20 nt, Artificial Sequence
  Guide Sequence
cuguggggagggaaggguca

SEQ ID NO: 11698 - RNA, 20 nt, Artificial Sequence
  Guide Sequence
cuguucucagccccuucccu

SEQ ID NO: 11699 - RNA, 20 nt, Artificial Sequence
  Guide Sequence
cuucccuccuggcugugagc

SEQ ID NO: 11700 - RNA, 20 nt, Artificial Sequence
  Guide Sequence
cuugggcagcgacuaaggga

SEQ ID NO: 11701 - RNA, 20 nt, Artificial Sequence
  Guide Sequence
cuuucuccugucucugggca

SEQ ID NO: 11702 - RNA, 20 nt, Artificial Sequence
  Guide Sequence
cuuuggaaaugcuugggcag

SEQ ID NO: 11703 - RNA, 20 nt, Artificial Sequence
  Guide Sequence
gaaaaaucaauugggaaaag

SEQ ID NO: 11704 - RNA, 20 nt, Artificial Sequence
  Guide Sequence
gaaaagucagacaggacugu

SEQ ID NO: 11705 - RNA, 20 nt, Artificial Sequence
  Guide Sequence
gaaaugcuugggcagcgacu

SEQ ID NO: 11706 - RNA, 20 nt, Artificial Sequence
  Guide Sequence
gaagggucaugcaggcccca

SEQ ID NO: 11707 - RNA, 20 nt, Artificial Sequence
  Guide Sequence
gacaccacagccagccugcc

SEQ ID NO: 11708 - RNA, 20 nt, Artificial Sequence
  Guide Sequence
gacaggacuguccuuucucc

SEQ ID NO: 11709 - RNA, 20 nt, Artificial Sequence
  Guide Sequence
gacccagccccaccccaaac

SEQ ID NO: 11710 - RNA, 20 nt, Artificial Sequence
  Guide Sequence
gaccccaccagcacccuggg

SEQ ID NO: 11711 - RNA, 20 nt, Artificial Sequence
  Guide Sequence
gacgggguguuguuugugca

SEQ ID NO: 11712 - RNA, 20 nt, Artificial Sequence
  Guide Sequence
gacuaagggacccagcccca

SEQ ID NO: 11713 - RNA, 20 nt, Artificial Sequence
  Guide Sequence
gacuguccuuucuccugucu

SEQ ID NO: 11714 - RNA, 20 nt, Artificial Sequence
  Guide Sequence
gagaaggaaauaagucuacc

SEQ ID NO: 11715 - RNA, 20 nt, Artificial Sequence
  Guide Sequence
gagacaccacagccagccug

SEQ ID NO: 11716 - RNA, 20 nt, Artificial Sequence
  Guide Sequence
gagcacagguccuguucuca

SEQ ID NO: 11717 - RNA, 20 nt, Artificial Sequence
  Guide Sequence
gagccccccugggagcugac

SEQ ID NO: 11718 - RNA, 20 nt, Artificial Sequence
  Guide Sequence
gagcugacgggguguuguuu

SEQ ID NO: 11719 - RNA, 20 nt, Artificial Sequence
  Guide Sequence
gagcugggggcaguaguggg

SEQ ID NO: 11720 - RNA, 20 nt, Artificial Sequence
  Guide Sequence
gagggaagggucaugcaggc

SEQ ID NO: 11721 - RNA, 20 nt, Artificial Sequence
  Guide Sequence
gagggcccuagucaggugca

SEQ ID NO: 11722 - RNA, 20 nt, Artificial Sequence
  Guide Sequence
gaucaaaagccccgaaaaau

SEQ ID NO: 11723 - RNA, 20 nt, Artificial Sequence
  Guide Sequence
gauuacaggggugagacacc

SEQ ID NO: 11724 - RNA, 20 nt, Artificial Sequence
  Guide Sequence
gcaagcauuuagaucaaaag

SEQ ID NO: 11725 - RNA, 20 nt, Artificial Sequence
  Guide Sequence
gcacagguccuguucucagc

SEQ ID NO: 11726 - RNA, 20 nt, Artificial Sequence
  Guide Sequence
gcaccaacaggaaaagucag

SEQ ID NO: 11727 - RNA, 20 nt, Artificial Sequence
  Guide Sequence
gcacccugggcugugcccuc

SEQ ID NO: 11728 - RNA, 20 nt, Artificial Sequence
  Guide Sequence
gcagcaccaacaggaaaagu

SEQ ID NO: 11729 - RNA, 20 nt, Artificial Sequence
  Guide Sequence
gcagcccuccucugacccca

SEQ ID NO: 11730 - RNA, 20 nt, Artificial Sequence
  Guide Sequence
gcagcgacuaagggacccag

SEQ ID NO: 11731 - RNA, 20 nt, Artificial Sequence
  Guide Sequence
gcaggccccagugagcacag

SEQ ID NO: 11732 - RNA, 20 nt, Artificial Sequence
  Guide Sequence
gcaguagugggagccccccu

SEQ ID NO: 11733 - RNA, 20 nt, Artificial Sequence
  Guide Sequence
gcauucuaacgagcuggggg

SEQ ID NO: 11734 - RNA, 20 nt, Artificial Sequence
  Guide Sequence
gcauuuagaucaaaagcccc

SEQ ID NO: 11735 - RNA, 20 nt, Artificial Sequence
  Guide Sequence
gccaagucccacugagggcc

SEQ ID NO: 11736 - RNA, 20 nt, Artificial Sequence
  Guide Sequence
gccaccugccgccagccaag

SEQ ID NO: 11737 - RNA, 20 nt, Artificial Sequence
  Guide Sequence
gccagccaagucccacugag

SEQ ID NO: 11738 - RNA, 20 nt, Artificial Sequence
  Guide Sequence
gccagccugccuccaaauuu

SEQ ID NO: 11739 - RNA, 20 nt, Artificial Sequence
  Guide Sequence
gccccagugagcacaggucc

SEQ ID NO: 11740 - RNA, 20 nt, Artificial Sequence
  Guide Sequence
gccccccugggagcugacgg

SEQ ID NO: 11741 - RNA, 20 nt, Artificial Sequence
  Guide Sequence
gccccgaaaaaucaauuggg

SEQ ID NO: 11742 - RNA, 20 nt, Artificial Sequence
  Guide Sequence
gccccuucccuccuggcugu

SEQ ID NO: 11743 - RNA, 20 nt, Artificial Sequence
  Guide Sequence
gcccuagucaggugcauucu

SEQ ID NO: 11744 - RNA, 20 nt, Artificial Sequence
  Guide Sequence
gcccuccagagaaggaaaua

SEQ ID NO: 11745 - RNA, 20 nt, Artificial Sequence
  Guide Sequence
gcccuccucugaccccacca

SEQ ID NO: 11746 - RNA, 20 nt, Artificial Sequence
  Guide Sequence
gccgccagccaagucccacu

SEQ ID NO: 11747 - RNA, 20 nt, Artificial Sequence
  Guide Sequence
gccuccaaauuucuaagcag

SEQ ID NO: 11748 - RNA, 20 nt, Artificial Sequence
  Guide Sequence
gccugccuccaaauuucuaa

SEQ ID NO: 11749 - RNA, 20 nt, Artificial Sequence
  Guide Sequence
gcgacuaagggacccagccc

SEQ ID NO: 11750 - RNA, 20 nt, Artificial Sequence
  Guide Sequence
gcugacgggguguuguuugu

SEQ ID NO: 11751 - RNA, 20 nt, Artificial Sequence
  Guide Sequence
gcugggauuacaggggugag

SEQ ID NO: 11752 - RNA, 20 nt, Artificial Sequence
  Guide Sequence
gcugggggcaguagugggag

SEQ ID NO: 11753 - RNA, 20 nt, Artificial Sequence
  Guide Sequence
gcugugcccuccagagaagg

SEQ ID NO: 11754 - RNA, 20 nt, Artificial Sequence
  Guide Sequence
gcuugggcagcgacuaaggg

SEQ ID NO: 11755 - RNA, 20 nt, Artificial Sequence
  Guide Sequence
gcuuuggaaaugcuugggca

SEQ ID NO: 11756 - RNA, 20 nt, Artificial Sequence
  Guide Sequence
ggaaaagucagacaggacug

SEQ ID NO: 11757 - RNA, 20 nt, Artificial Sequence
  Guide Sequence
ggaaaugcuugggcagcgac

SEQ ID NO: 11758 - RNA, 20 nt, Artificial Sequence
  Guide Sequence
ggaagggucaugcaggcccc

SEQ ID NO: 11759 - RNA, 20 nt, Artificial Sequence
  Guide Sequence
ggacccagccccaccccaaa

SEQ ID NO: 11760 - RNA, 20 nt, Artificial Sequence
  Guide Sequence
ggacuguccuuucuccuguc

SEQ ID NO: 11761 - RNA, 20 nt, Artificial Sequence
  Guide Sequence
ggagccccccugggagcuga

SEQ ID NO: 11762 - RNA, 20 nt, Artificial Sequence
  Guide Sequence
ggagcugacgggguguuguu

SEQ ID NO: 11763 - RNA, 20 nt, Artificial Sequence
  Guide Sequence
ggagggaagggucaugcagg

SEQ ID NO: 11764 - RNA, 20 nt, Artificial Sequence
  Guide Sequence
ggauuacaggggugagacac

SEQ ID NO: 11765 - RNA, 20 nt, Artificial Sequence
  Guide Sequence
ggcagcccuccucugacccc

SEQ ID NO: 11766 - RNA, 20 nt, Artificial Sequence
  Guide Sequence
ggcagcgacuaagggaccca

SEQ ID NO: 11767 - RNA, 20 nt, Artificial Sequence
  Guide Sequence
ggcaguagugggagcccccc

SEQ ID NO: 11768 - RNA, 20 nt, Artificial Sequence
  Guide Sequence
ggccccagugagcacagguc

SEQ ID NO: 11769 - RNA, 20 nt, Artificial Sequence
  Guide Sequence
ggcccuagucaggugcauuc

SEQ ID NO: 11770 - RNA, 20 nt, Artificial Sequence
  Guide Sequence
ggcugugcccuccagagaag

SEQ ID NO: 11771 - RNA, 20 nt, Artificial Sequence
  Guide Sequence
ggcuuuggaaaugcuugggc

SEQ ID NO: 11772 - RNA, 20 nt, Artificial Sequence
  Guide Sequence
gggaagggucaugcaggccc

SEQ ID NO: 11773 - RNA, 20 nt, Artificial Sequence
  Guide Sequence
gggacccagccccaccccaa

SEQ ID NO: 11774 - RNA, 20 nt, Artificial Sequence
  Guide Sequence
gggagccccccugggagcug

SEQ ID NO: 11775 - RNA, 20 nt, Artificial Sequence
  Guide Sequence
gggagcugacgggguguugu

SEQ ID NO: 11776 - RNA, 20 nt, Artificial Sequence
  Guide Sequence
gggagggaagggucaugcag

SEQ ID NO: 11777 - RNA, 20 nt, Artificial Sequence
  Guide Sequence
gggauuacaggggugagaca

SEQ ID NO: 11778 - RNA, 20 nt, Artificial Sequence
  Guide Sequence
gggcagcccuccucugaccc

SEQ ID NO: 11779 - RNA, 20 nt, Artificial Sequence
  Guide Sequence
gggcagcgacuaagggaccc

SEQ ID NO: 11780 - RNA, 20 nt, Artificial Sequence
  Guide Sequence
gggcaguagugggagccccc

SEQ ID NO: 11781 - RNA, 20 nt, Artificial Sequence
  Guide Sequence
gggcccuagucaggugcauu

SEQ ID NO: 11782 - RNA, 20 nt, Artificial Sequence
  Guide Sequence
gggcugugcccuccagagaa

SEQ ID NO: 11783 - RNA, 20 nt, Artificial Sequence
  Guide Sequence
gggcuuuggaaaugcuuggg

SEQ ID NO: 11784 - RNA, 20 nt, Artificial Sequence
  Guide Sequence
ggggagggaagggucaugca

SEQ ID NO: 11785 - RNA, 20 nt, Artificial Sequence
  Guide Sequence
ggggcaguagugggagcccc

SEQ ID NO: 11786 - RNA, 20 nt, Artificial Sequence
  Guide Sequence
gggggcaguagugggagccc

SEQ ID NO: 11787 - RNA, 20 nt, Artificial Sequence
  Guide Sequence
ggggugagacaccacagcca

SEQ ID NO: 11788 - RNA, 20 nt, Artificial Sequence
  Guide Sequence
gggguguuguuugugcaagc

SEQ ID NO: 11789 - RNA, 20 nt, Artificial Sequence
  Guide Sequence
gggucaugcaggccccagug

SEQ ID NO: 11790 - RNA, 20 nt, Artificial Sequence
  Guide Sequence
gggugagacaccacagccag

SEQ ID NO: 11791 - RNA, 20 nt, Artificial Sequence
  Guide Sequence
ggguguuguuugugcaagca

SEQ ID NO: 11792 - RNA, 20 nt, Artificial Sequence
  Guide Sequence
ggucaugcaggccccaguga

SEQ ID NO: 11793 - RNA, 20 nt, Artificial Sequence
  Guide Sequence
gguccuguucucagccccuu

SEQ ID NO: 11794 - RNA, 20 nt, Artificial Sequence
  Guide Sequence
ggugagacaccacagccagc

SEQ ID NO: 11795 - RNA, 20 nt, Artificial Sequence
  Guide Sequence
ggugcauucuaacgagcugg

SEQ ID NO: 11796 - RNA, 20 nt, Artificial Sequence
  Guide Sequence
gguguuguuugugcaagcau

SEQ ID NO: 11797 - RNA, 20 nt, Artificial Sequence
  Guide Sequence
guagugggagccccccuggg

SEQ ID NO: 11798 - RNA, 20 nt, Artificial Sequence
  Guide Sequence
guaugggcuuuggaaaugcu

SEQ ID NO: 11799 - RNA, 20 nt, Artificial Sequence
  Guide Sequence
gucagacaggacuguccuuu

SEQ ID NO: 11800 - RNA, 20 nt, Artificial Sequence
  Guide Sequence
gucaggugcauucuaacgag

SEQ ID NO: 11801 - RNA, 20 nt, Artificial Sequence
  Guide Sequence
gucaugcaggccccagugag

SEQ ID NO: 11802 - RNA, 20 nt, Artificial Sequence
  Guide Sequence
gucccacugagggcccuagu

SEQ ID NO: 11803 - RNA, 20 nt, Artificial Sequence
  Guide Sequence
guccuguucucagccccuuc

SEQ ID NO: 11804 - RNA, 20 nt, Artificial Sequence
  Guide Sequence
guccuuucuccugucucugg

SEQ ID NO: 11805 - RNA, 20 nt, Artificial Sequence
  Guide Sequence
gucucugggcagcccuccuc

SEQ ID NO: 11806 - RNA, 20 nt, Artificial Sequence
  Guide Sequence
gugagacaccacagccagcc

SEQ ID NO: 11807 - RNA, 20 nt, Artificial Sequence
  Guide Sequence
gugagcacagguccuguucu

SEQ ID NO: 11808 - RNA, 20 nt, Artificial Sequence
  Guide Sequence
gugcaagcauuuagaucaaa

SEQ ID NO: 11809 - RNA, 20 nt, Artificial Sequence
  Guide Sequence
gugcauucuaacgagcuggg

SEQ ID NO: 11810 - RNA, 20 nt, Artificial Sequence
  Guide Sequence
gugcccuccagagaaggaaa

SEQ ID NO: 11811 - RNA, 20 nt, Artificial Sequence
  Guide Sequence
gugcugggauuacaggggug

SEQ ID NO: 11812 - RNA, 20 nt, Artificial Sequence
  Guide Sequence
gugggagccccccugggagc

SEQ ID NO: 11813 - RNA, 20 nt, Artificial Sequence
  Guide Sequence
guggggagggaagggucaug

SEQ ID NO: 11814 - RNA, 20 nt, Artificial Sequence
  Guide Sequence
guguuguuugugcaagcauu

SEQ ID NO: 11815 - RNA, 20 nt, Artificial Sequence
  Guide Sequence
guucucagccccuucccucc

SEQ ID NO: 11816 - RNA, 20 nt, Artificial Sequence
  Guide Sequence
guuguuugugcaagcauuua

SEQ ID NO: 11817 - RNA, 20 nt, Artificial Sequence
  Guide Sequence
guuugugcaagcauuuagau

SEQ ID NO: 11818 - RNA, 20 nt, Artificial Sequence
  Guide Sequence
uaacgagcugggggcaguag

SEQ ID NO: 11819 - RNA, 20 nt, Artificial Sequence
  Guide Sequence
uaagcagcaccaacaggaaa

SEQ ID NO: 11820 - RNA, 20 nt, Artificial Sequence
  Guide Sequence
uaagggacccagccccaccc

SEQ ID NO: 11821 - RNA, 20 nt, Artificial Sequence
  Guide Sequence
uacaggggugagacaccaca

SEQ ID NO: 11822 - RNA, 20 nt, Artificial Sequence
  Guide Sequence
uagaucaaaagccccgaaaa

SEQ ID NO: 11823 - RNA, 20 nt, Artificial Sequence
  Guide Sequence
uagucaggugcauucuaacg

SEQ ID NO: 11824 - RNA, 20 nt, Artificial Sequence
  Guide Sequence
uagugggagccccccuggga

SEQ ID NO: 11825 - RNA, 20 nt, Artificial Sequence
  Guide Sequence
uaugggcuuuggaaaugcuu

SEQ ID NO: 11826 - RNA, 20 nt, Artificial Sequence
  Guide Sequence
ucaaaagccccgaaaaauca

SEQ ID NO: 11827 - RNA, 20 nt, Artificial Sequence
  Guide Sequence
ucagacaggacuguccuuuc

SEQ ID NO: 11828 - RNA, 20 nt, Artificial Sequence
  Guide Sequence
ucagccccuucccuccuggc

SEQ ID NO: 11829 - RNA, 20 nt, Artificial Sequence
  Guide Sequence
ucaggugcauucuaacgagc

SEQ ID NO: 11830 - RNA, 20 nt, Artificial Sequence
  Guide Sequence
ucaugcaggccccagugagc

SEQ ID NO: 11831 - RNA, 20 nt, Artificial Sequence
  Guide Sequence
uccaaauuucuaagcagcac

SEQ ID NO: 11832 - RNA, 20 nt, Artificial Sequence
  Guide Sequence
uccagagaaggaaauaaguc

SEQ ID NO: 11833 - RNA, 20 nt, Artificial Sequence
  Guide Sequence
ucccacugagggcccuaguc

SEQ ID NO: 11834 - RNA, 20 nt, Artificial Sequence
  Guide Sequence
ucccuccuggcugugagcca

SEQ ID NO: 11835 - RNA, 20 nt, Artificial Sequence
  Guide Sequence
uccucugaccccaccagcac

SEQ ID NO: 11836 - RNA, 20 nt, Artificial Sequence
  Guide Sequence
uccuggcugugagccaggcu

SEQ ID NO: 11837 - RNA, 20 nt, Artificial Sequence
  Guide Sequence
uccugucucugggcagcccu

SEQ ID NO: 11838 - RNA, 20 nt, Artificial Sequence
  Guide Sequence
uccuguucucagccccuucc

SEQ ID NO: 11839 - RNA, 20 nt, Artificial Sequence
  Guide Sequence
uccuuucuccugucucuggg

SEQ ID NO: 11840 - RNA, 20 nt, Artificial Sequence
  Guide Sequence
ucuaacgagcugggggcagu

SEQ ID NO: 11841 - RNA, 20 nt, Artificial Sequence
  Guide Sequence
ucuaagcagcaccaacagga

SEQ ID NO: 11842 - RNA, 20 nt, Artificial Sequence
  Guide Sequence
ucucagccccuucccuccug

SEQ ID NO: 11843 - RNA, 20 nt, Artificial Sequence
  Guide Sequence
ucuccugucucugggcagcc

SEQ ID NO: 11844 - RNA, 20 nt, Artificial Sequence
  Guide Sequence
ucucugggcagcccuccucu

SEQ ID NO: 11845 - RNA, 20 nt, Artificial Sequence
  Guide Sequence
ucugaccccaccagcacccu

SEQ ID NO: 11846 - RNA, 20 nt, Artificial Sequence
  Guide Sequence
ucugggcagcccuccucuga

SEQ ID NO: 11847 - RNA, 20 nt, Artificial Sequence
  Guide Sequence
ugaccccaccagcacccugg

SEQ ID NO: 11848 - RNA, 20 nt, Artificial Sequence
  Guide Sequence
ugacgggguguuguuugugc

SEQ ID NO: 11849 - RNA, 20 nt, Artificial Sequence
  Guide Sequence
ugagacaccacagccagccu

SEQ ID NO: 11850 - RNA, 20 nt, Artificial Sequence
  Guide Sequence
ugagcacagguccuguucuc

SEQ ID NO: 11851 - RNA, 20 nt, Artificial Sequence
  Guide Sequence
ugagggcccuagucaggugc

SEQ ID NO: 11852 - RNA, 20 nt, Artificial Sequence
  Guide Sequence
ugcaagcauuuagaucaaaa

SEQ ID NO: 11853 - RNA, 20 nt, Artificial Sequence
  Guide Sequence
ugcaggccccagugagcaca

SEQ ID NO: 11854 - RNA, 20 nt, Artificial Sequence
  Guide Sequence
ugcauucuaacgagcugggg

SEQ ID NO: 11855 - RNA, 20 nt, Artificial Sequence
  Guide Sequence
ugcccuccagagaaggaaau

SEQ ID NO: 11856 - RNA, 20 nt, Artificial Sequence
  Guide Sequence
ugccgccagccaagucccac

SEQ ID NO: 11857 - RNA, 20 nt, Artificial Sequence
  Guide Sequence
ugccuccaaauuucuaagca

SEQ ID NO: 11858 - RNA, 20 nt, Artificial Sequence
  Guide Sequence
ugcugggauuacagggguga

SEQ ID NO: 11859 - RNA, 20 nt, Artificial Sequence
  Guide Sequence
ugcuugggcagcgacuaagg

SEQ ID NO: 11860 - RNA, 20 nt, Artificial Sequence
  Guide Sequence
uggaaaugcuugggcagcga

SEQ ID NO: 11861 - RNA, 20 nt, Artificial Sequence
  Guide Sequence
ugggagccccccugggagcu

SEQ ID NO: 11862 - RNA, 20 nt, Artificial Sequence
  Guide Sequence
ugggagcugacgggguguug

SEQ ID NO: 11863 - RNA, 20 nt, Artificial Sequence
  Guide Sequence
ugggauuacaggggugagac

SEQ ID NO: 11864 - RNA, 20 nt, Artificial Sequence
  Guide Sequence
ugggcagcccuccucugacc

SEQ ID NO: 11865 - RNA, 20 nt, Artificial Sequence
  Guide Sequence
ugggcagcgacuaagggacc

SEQ ID NO: 11866 - RNA, 20 nt, Artificial Sequence
  Guide Sequence
ugggcugugcccuccagaga

SEQ ID NO: 11867 - RNA, 20 nt, Artificial Sequence
  Guide Sequence
ugggcuuuggaaaugcuugg

SEQ ID NO: 11868 - RNA, 20 nt, Artificial Sequence
  Guide Sequence
uggggagggaagggucaugc

SEQ ID NO: 11869 - RNA, 20 nt, Artificial Sequence
  Guide Sequence
ugggggcaguagugggagcc

SEQ ID NO: 11870 - RNA, 20 nt, Artificial Sequence
  Guide Sequence
uguccuuucuccugucucug

SEQ ID NO: 11871 - RNA, 20 nt, Artificial Sequence
  Guide Sequence
ugucucugggcagcccuccu

SEQ ID NO: 11872 - RNA, 20 nt, Artificial Sequence
  Guide Sequence
ugugcaagcauuuagaucaa

SEQ ID NO: 11873 - RNA, 20 nt, Artificial Sequence
  Guide Sequence
ugugcccuccagagaaggaa

SEQ ID NO: 11874 - RNA, 20 nt, Artificial Sequence
  Guide Sequence
uguggggagggaagggucau

SEQ ID NO: 11875 - RNA, 20 nt, Artificial Sequence
  Guide Sequence
uguucucagccccuucccuc

SEQ ID NO: 11876 - RNA, 20 nt, Artificial Sequence
  Guide Sequence
uguuguuugugcaagcauuu

SEQ ID NO: 11877 - RNA, 20 nt, Artificial Sequence
  Guide Sequence
uguuugugcaagcauuuaga

SEQ ID NO: 11878 - RNA, 20 nt, Artificial Sequence
  Guide Sequence
uuacaggggugagacaccac

SEQ ID NO: 11879 - RNA, 20 nt, Artificial Sequence
  Guide Sequence
uuagaucaaaagccccgaaa

SEQ ID NO: 11880 - RNA, 20 nt, Artificial Sequence
  Guide Sequence
uucccuccuggcugugagcc

SEQ ID NO: 11881 - RNA, 20 nt, Artificial Sequence
  Guide Sequence
uucuaacgagcugggggcag

SEQ ID NO: 11882 - RNA, 20 nt, Artificial Sequence
  Guide Sequence
uucuaagcagcaccaacagg

SEQ ID NO: 11883 - RNA, 20 nt, Artificial Sequence
  Guide Sequence
uucucagccccuucccuccu

SEQ ID NO: 11884 - RNA, 20 nt, Artificial Sequence
  Guide Sequence
uucuccugucucugggcagc

SEQ ID NO: 11885 - RNA, 20 nt, Artificial Sequence
  Guide Sequence
uuggaaaugcuugggcagcg

SEQ ID NO: 11886 - RNA, 20 nt, Artificial Sequence
  Guide Sequence
uugggcagcgacuaagggac

SEQ ID NO: 11887 - RNA, 20 nt, Artificial Sequence
  Guide Sequence
uugugcaagcauuuagauca

SEQ ID NO: 11888 - RNA, 20 nt, Artificial Sequence
  Guide Sequence
uuguuugugcaagcauuuag

SEQ ID NO: 11889 - RNA, 20 nt, Artificial Sequence
  Guide Sequence
uuuagaucaaaagccccgaa

SEQ ID NO: 11890 - RNA, 20 nt, Artificial Sequence
  Guide Sequence
uuucuaagcagcaccaacag

SEQ ID NO: 11891 - RNA, 20 nt, Artificial Sequence
  Guide Sequence
uuucuccugucucugggcag

SEQ ID NO: 11892 - RNA, 20 nt, Artificial Sequence
  Guide Sequence
uuuggaaaugcuugggcagc

SEQ ID NO: 11893 - RNA, 20 nt, Artificial Sequence
  Guide Sequence
uuugugcaagcauuuagauc

SEQ ID NO: 11894 - RNA, 21 nt, Artificial Sequence
  Guide Sequence
aaaagccccgaaaaaucaauu

SEQ ID NO: 11895 - RNA, 21 nt, Artificial Sequence
  Guide Sequence
aaaagucagacaggacugucc

SEQ ID NO: 11896 - RNA, 21 nt, Artificial Sequence
  Guide Sequence
aaagccaccugccgccagcca

SEQ ID NO: 11897 - RNA, 21 nt, Artificial Sequence
  Guide Sequence
aaagccccgaaaaaucaauug

SEQ ID NO: 11898 - RNA, 21 nt, Artificial Sequence
  Guide Sequence
aaaguaugggcuuuggaaaug

SEQ ID NO: 11899 - RNA, 21 nt, Artificial Sequence
  Guide Sequence
aaagucagacaggacuguccu

SEQ ID NO: 11900 - RNA, 21 nt, Artificial Sequence
  Guide Sequence
aaagugcugggauuacagggg

SEQ ID NO: 11901 - RNA, 21 nt, Artificial Sequence
  Guide Sequence
aaaugcuugggcagcgacuaa

SEQ ID NO: 11902 - RNA, 21 nt, Artificial Sequence
  Guide Sequence
aaauuucuaagcagcaccaac

SEQ ID NO: 11903 - RNA, 21 nt, Artificial Sequence
  Guide Sequence
aacaggaaaagucagacagga

SEQ ID NO: 11904 - RNA, 21 nt, Artificial Sequence
  Guide Sequence
aacgagcugggggcaguagug

SEQ ID NO: 11905 - RNA, 21 nt, Artificial Sequence
  Guide Sequence
aagcagcaccaacaggaaaag

SEQ ID NO: 11906 - RNA, 21 nt, Artificial Sequence
  Guide Sequence
aagcauuuagaucaaaagccc

SEQ ID NO: 11907 - RNA, 21 nt, Artificial Sequence
  Guide Sequence
aagccaccugccgccagccaa

SEQ ID NO: 11908 - RNA, 21 nt, Artificial Sequence
  Guide Sequence
aagccccgaaaaaucaauugg

SEQ ID NO: 11909 - RNA, 21 nt, Artificial Sequence
  Guide Sequence
aagggacccagccccacccca

SEQ ID NO: 11910 - RNA, 21 nt, Artificial Sequence
  Guide Sequence
aagggucaugcaggccccagu

SEQ ID NO: 11911 - RNA, 21 nt, Artificial Sequence
  Guide Sequence
aaguaugggcuuuggaaaugc

SEQ ID NO: 11912 - RNA, 21 nt, Artificial Sequence
  Guide Sequence
aagucagacaggacuguccuu

SEQ ID NO: 11913 - RNA, 21 nt, Artificial Sequence
  Guide Sequence
aagucccacugagggcccuag

SEQ ID NO: 11914 - RNA, 21 nt, Artificial Sequence
  Guide Sequence
aagugcugggauuacaggggu

SEQ ID NO: 11915 - RNA, 21 nt, Artificial Sequence
  Guide Sequence
aaugcuugggcagcgacuaag

SEQ ID NO: 11916 - RNA, 21 nt, Artificial Sequence
  Guide Sequence
aauuucuaagcagcaccaaca

SEQ ID NO: 11917 - RNA, 21 nt, Artificial Sequence
  Guide Sequence
acaccacagccagccugccuc

SEQ ID NO: 11918 - RNA, 21 nt, Artificial Sequence
  Guide Sequence
acagccagccugccuccaaau

SEQ ID NO: 11919 - RNA, 21 nt, Artificial Sequence
  Guide Sequence
acaggaaaagucagacaggac

SEQ ID NO: 11920 - RNA, 21 nt, Artificial Sequence
  Guide Sequence
acaggacuguccuuucuccug

SEQ ID NO: 11921 - RNA, 21 nt, Artificial Sequence
  Guide Sequence
acaggggugagacaccacagc

SEQ ID NO: 11922 - RNA, 21 nt, Artificial Sequence
  Guide Sequence
acagguccuguucucagcccc

SEQ ID NO: 11923 - RNA, 21 nt, Artificial Sequence
  Guide Sequence
accaacaggaaaagucagaca

SEQ ID NO: 11924 - RNA, 21 nt, Artificial Sequence
  Guide Sequence
accacagccagccugccucca

SEQ ID NO: 11925 - RNA, 21 nt, Artificial Sequence
  Guide Sequence
accagcacccugggcugugcc

SEQ ID NO: 11926 - RNA, 21 nt, Artificial Sequence
  Guide Sequence
acccagccccaccccaaacgc

SEQ ID NO: 11927 - RNA, 21 nt, Artificial Sequence
  Guide Sequence
accccaccagcacccugggcu

SEQ ID NO: 11928 - RNA, 21 nt, Artificial Sequence
  Guide Sequence
acccugggcugugcccuccag

SEQ ID NO: 11929 - RNA, 21 nt, Artificial Sequence
  Guide Sequence
accugccgccagccaaguccc

SEQ ID NO: 11930 - RNA, 21 nt, Artificial Sequence
  Guide Sequence
acgagcugggggcaguagugg

SEQ ID NO: 11931 - RNA, 21 nt, Artificial Sequence
  Guide Sequence
acgggguguuguuugugcaag

SEQ ID NO: 11932 - RNA, 21 nt, Artificial Sequence
  Guide Sequence
acuaagggacccagccccacc

SEQ ID NO: 11933 - RNA, 21 nt, Artificial Sequence
  Guide Sequence
acugagggcccuagucaggug

SEQ ID NO: 11934 - RNA, 21 nt, Artificial Sequence
  Guide Sequence
acuguccuuucuccugucucu

SEQ ID NO: 11935 - RNA, 21 nt, Artificial Sequence
  Guide Sequence
agacaccacagccagccugcc

SEQ ID NO: 11936 - RNA, 21 nt, Artificial Sequence
  Guide Sequence
agacaggacuguccuuucucc

SEQ ID NO: 11937 - RNA, 21 nt, Artificial Sequence
  Guide Sequence
agagaaggaaauaagucuacc

SEQ ID NO: 11938 - RNA, 21 nt, Artificial Sequence
  Guide Sequence
agaucaaaagccccgaaaaau

SEQ ID NO: 11939 - RNA, 21 nt, Artificial Sequence
  Guide Sequence
agcacagguccuguucucagc

SEQ ID NO: 11940 - RNA, 21 nt, Artificial Sequence
  Guide Sequence
agcaccaacaggaaaagucag

SEQ ID NO: 11941 - RNA, 21 nt, Artificial Sequence
  Guide Sequence
agcacccugggcugugcccuc

SEQ ID NO: 11942 - RNA, 21 nt, Artificial Sequence
  Guide Sequence
agcagcaccaacaggaaaagu

SEQ ID NO: 11943 - RNA, 21 nt, Artificial Sequence
  Guide Sequence
agcauuuagaucaaaagcccc

SEQ ID NO: 11944 - RNA, 21 nt, Artificial Sequence
  Guide Sequence
agccaagucccacugagggcc

SEQ ID NO: 11945 - RNA, 21 nt, Artificial Sequence
  Guide Sequence
agccaccugccgccagccaag

SEQ ID NO: 11946 - RNA, 21 nt, Artificial Sequence
  Guide Sequence
agccagccugccuccaaauuu

SEQ ID NO: 11947 - RNA, 21 nt, Artificial Sequence
  Guide Sequence
agccccccugggagcugacgg

SEQ ID NO: 11948 - RNA, 21 nt, Artificial Sequence
  Guide Sequence
agccccgaaaaaucaauuggg

SEQ ID NO: 11949 - RNA, 21 nt, Artificial Sequence
  Guide Sequence
agccccuucccuccuggcugu

SEQ ID NO: 11950 - RNA, 21 nt, Artificial Sequence
  Guide Sequence
agcccuccucugaccccacca

SEQ ID NO: 11951 - RNA, 21 nt, Artificial Sequence
  Guide Sequence
agccugccuccaaauuucuaa

SEQ ID NO: 11952 - RNA, 21 nt, Artificial Sequence
  Guide Sequence
agcgacuaagggacccagccc

SEQ ID NO: 11953 - RNA, 21 nt, Artificial Sequence
  Guide Sequence
agcugacgggguguuguuugu

SEQ ID NO: 11954 - RNA, 21 nt, Artificial Sequence
  Guide Sequence
agcugggggcaguagugggag

SEQ ID NO: 11955 - RNA, 21 nt, Artificial Sequence
  Guide Sequence
aggaaaagucagacaggacug

SEQ ID NO: 11956 - RNA, 21 nt, Artificial Sequence
  Guide Sequence
aggacuguccuuucuccuguc

SEQ ID NO: 11957 - RNA, 21 nt, Artificial Sequence
  Guide Sequence
aggccccagugagcacagguc

SEQ ID NO: 11958 - RNA, 21 nt, Artificial Sequence
  Guide Sequence
agggaagggucaugcaggccc

SEQ ID NO: 11959 - RNA, 21 nt, Artificial Sequence
  Guide Sequence
agggacccagccccaccccaa

SEQ ID NO: 11960 - RNA, 21 nt, Artificial Sequence
  Guide Sequence
agggcccuagucaggugcauu

SEQ ID NO: 11961 - RNA, 21 nt, Artificial Sequence
  Guide Sequence
aggggugagacaccacagcca

SEQ ID NO: 11962 - RNA, 21 nt, Artificial Sequence
  Guide Sequence
agggucaugcaggccccagug

SEQ ID NO: 11963 - RNA, 21 nt, Artificial Sequence
  Guide Sequence
agguccuguucucagccccuu

SEQ ID NO: 11964 - RNA, 21 nt, Artificial Sequence
  Guide Sequence
aggugcauucuaacgagcugg

SEQ ID NO: 11965 - RNA, 21 nt, Artificial Sequence
  Guide Sequence
aguagugggagccccccuggg

SEQ ID NO: 11966 - RNA, 21 nt, Artificial Sequence
  Guide Sequence
aguaugggcuuuggaaaugcu

SEQ ID NO: 11967 - RNA, 21 nt, Artificial Sequence
  Guide Sequence
agucagacaggacuguccuuu

SEQ ID NO: 11968 - RNA, 21 nt, Artificial Sequence
  Guide Sequence
agucaggugcauucuaacgag

SEQ ID NO: 11969 - RNA, 21 nt, Artificial Sequence
  Guide Sequence
agucccacugagggcccuagu

SEQ ID NO: 11970 - RNA, 21 nt, Artificial Sequence
  Guide Sequence
agugagcacagguccuguucu

SEQ ID NO: 11971 - RNA, 21 nt, Artificial Sequence
  Guide Sequence
agugcugggauuacaggggug

SEQ ID NO: 11972 - RNA, 21 nt, Artificial Sequence
  Guide Sequence
agugggagccccccugggagc

SEQ ID NO: 11973 - RNA, 21 nt, Artificial Sequence
  Guide Sequence
aucaaaagccccgaaaaauca

SEQ ID NO: 11974 - RNA, 21 nt, Artificial Sequence
  Guide Sequence
augcaggccccagugagcaca

SEQ ID NO: 11975 - RNA, 21 nt, Artificial Sequence
  Guide Sequence
augcuugggcagcgacuaagg

SEQ ID NO: 11976 - RNA, 21 nt, Artificial Sequence
  Guide Sequence
augggcuuuggaaaugcuugg

SEQ ID NO: 11977 - RNA, 21 nt, Artificial Sequence
  Guide Sequence
auuacaggggugagacaccac

SEQ ID NO: 11978 - RNA, 21 nt, Artificial Sequence
  Guide Sequence
auucuaacgagcugggggcag

SEQ ID NO: 11979 - RNA, 21 nt, Artificial Sequence
  Guide Sequence
auuuagaucaaaagccccgaa

SEQ ID NO: 11980 - RNA, 21 nt, Artificial Sequence
  Guide Sequence
auuucuaagcagcaccaacag

SEQ ID NO: 11981 - RNA, 21 nt, Artificial Sequence
  Guide Sequence
caaaagccccgaaaaaucaau

SEQ ID NO: 11982 - RNA, 21 nt, Artificial Sequence
  Guide Sequence
caaagugcugggauuacaggg

SEQ ID NO: 11983 - RNA, 21 nt, Artificial Sequence
  Guide Sequence
caaauuucuaagcagcaccaa

SEQ ID NO: 11984 - RNA, 21 nt, Artificial Sequence
  Guide Sequence
caacaggaaaagucagacagg

SEQ ID NO: 11985 - RNA, 21 nt, Artificial Sequence
  Guide Sequence
caagcauuuagaucaaaagcc

SEQ ID NO: 11986 - RNA, 21 nt, Artificial Sequence
  Guide Sequence
caagucccacugagggcccua

SEQ ID NO: 11987 - RNA, 21 nt, Artificial Sequence
  Guide Sequence
cacagccagccugccuccaaa

SEQ ID NO: 11988 - RNA, 21 nt, Artificial Sequence
  Guide Sequence
cacagguccuguucucagccc

SEQ ID NO: 11989 - RNA, 21 nt, Artificial Sequence
  Guide Sequence
caccaacaggaaaagucagac

SEQ ID NO: 11990 - RNA, 21 nt, Artificial Sequence
  Guide Sequence
caccacagccagccugccucc

SEQ ID NO: 11991 - RNA, 21 nt, Artificial Sequence
  Guide Sequence
caccagcacccugggcugugc

SEQ ID NO: 11992 - RNA, 21 nt, Artificial Sequence
  Guide Sequence
cacccugggcugugcccucca

SEQ ID NO: 11993 - RNA, 21 nt, Artificial Sequence
  Guide Sequence
caccugccgccagccaagucc

SEQ ID NO: 11994 - RNA, 21 nt, Artificial Sequence
  Guide Sequence
cacugagggcccuagucaggu

SEQ ID NO: 11995 - RNA, 21 nt, Artificial Sequence
  Guide Sequence
cagacaggacuguccuuucuc

SEQ ID NO: 11996 - RNA, 21 nt, Artificial Sequence
  Guide Sequence
cagagaaggaaauaagucuac

SEQ ID NO: 11997 - RNA, 21 nt, Artificial Sequence
  Guide Sequence
cagcaccaacaggaaaaguca

SEQ ID NO: 11998 - RNA, 21 nt, Artificial Sequence
  Guide Sequence
cagcacccugggcugugcccu

SEQ ID NO: 11999 - RNA, 21 nt, Artificial Sequence
  Guide Sequence
cagccaagucccacugagggc

SEQ ID NO: 12000 - RNA, 21 nt, Artificial Sequence
  Guide Sequence
cagccagccugccuccaaauu

SEQ ID NO: 12001 - RNA, 21 nt, Artificial Sequence
  Guide Sequence
cagccccaccccaaacgcagg

SEQ ID NO: 12002 - RNA, 21 nt, Artificial Sequence
  Guide Sequence
cagccccuucccuccuggcug

SEQ ID NO: 12003 - RNA, 21 nt, Artificial Sequence
  Guide Sequence
cagcccuccucugaccccacc

SEQ ID NO: 12004 - RNA, 21 nt, Artificial Sequence
  Guide Sequence
cagccugccuccaaauuucua

SEQ ID NO: 12005 - RNA, 21 nt, Artificial Sequence
  Guide Sequence
cagcgacuaagggacccagcc

SEQ ID NO: 12006 - RNA, 21 nt, Artificial Sequence
  Guide Sequence
caggaaaagucagacaggacu

SEQ ID NO: 12007 - RNA, 21 nt, Artificial Sequence
  Guide Sequence
caggacuguccuuucuccugu

SEQ ID NO: 12008 - RNA, 21 nt, Artificial Sequence
  Guide Sequence
caggccccagugagcacaggu

SEQ ID NO: 12009 - RNA, 21 nt, Artificial Sequence
  Guide Sequence
caggggugagacaccacagcc

SEQ ID NO: 12010 - RNA, 21 nt, Artificial Sequence
  Guide Sequence
cagguccuguucucagccccu

SEQ ID NO: 12011 - RNA, 21 nt, Artificial Sequence
  Guide Sequence
caggugcauucuaacgagcug

SEQ ID NO: 12012 - RNA, 21 nt, Artificial Sequence
  Guide Sequence
caguagugggagccccccugg

SEQ ID NO: 12013 - RNA, 21 nt, Artificial Sequence
  Guide Sequence
cagugagcacagguccuguuc

SEQ ID NO: 12014 - RNA, 21 nt, Artificial Sequence
  Guide Sequence
caugcaggccccagugagcac

SEQ ID NO: 12015 - RNA, 21 nt, Artificial Sequence
  Guide Sequence
cauucuaacgagcugggggca

SEQ ID NO: 12016 - RNA, 21 nt, Artificial Sequence
  Guide Sequence
cauuuagaucaaaagccccga

SEQ ID NO: 12017 - RNA, 21 nt, Artificial Sequence
  Guide Sequence
ccaaagugcugggauuacagg

SEQ ID NO: 12018 - RNA, 21 nt, Artificial Sequence
  Guide Sequence
ccaaauuucuaagcagcacca

SEQ ID NO: 12019 - RNA, 21 nt, Artificial Sequence
  Guide Sequence
ccaacaggaaaagucagacag

SEQ ID NO: 12020 - RNA, 21 nt, Artificial Sequence
  Guide Sequence
ccaagucccacugagggcccu

SEQ ID NO: 12021 - RNA, 21 nt, Artificial Sequence
  Guide Sequence
ccacagccagccugccuccaa

SEQ ID NO: 12022 - RNA, 21 nt, Artificial Sequence
  Guide Sequence
ccaccagcacccugggcugug

SEQ ID NO: 12023 - RNA, 21 nt, Artificial Sequence
  Guide Sequence
ccaccugccgccagccaaguc

SEQ ID NO: 12024 - RNA, 21 nt, Artificial Sequence
  Guide Sequence
ccacugagggcccuagucagg

SEQ ID NO: 12025 - RNA, 21 nt, Artificial Sequence
  Guide Sequence
ccagagaaggaaauaagucua

SEQ ID NO: 12026 - RNA, 21 nt, Artificial Sequence
  Guide Sequence
ccagcacccugggcugugccc

SEQ ID NO: 12027 - RNA, 21 nt, Artificial Sequence
  Guide Sequence
ccagccaagucccacugaggg

SEQ ID NO: 12028 - RNA, 21 nt, Artificial Sequence
  Guide Sequence
ccagccccaccccaaacgcag

SEQ ID NO: 12029 - RNA, 21 nt, Artificial Sequence
  Guide Sequence
ccagccugccuccaaauuucu

SEQ ID NO: 12030 - RNA, 21 nt, Artificial Sequence
  Guide Sequence
ccagugagcacagguccuguu

SEQ ID NO: 12031 - RNA, 21 nt, Artificial Sequence
  Guide Sequence
cccaaagugcugggauuacag

SEQ ID NO: 12032 - RNA, 21 nt, Artificial Sequence
  Guide Sequence
cccaccagcacccugggcugu

SEQ ID NO: 12033 - RNA, 21 nt, Artificial Sequence
  Guide Sequence
cccacugagggcccuagucag

SEQ ID NO: 12034 - RNA, 21 nt, Artificial Sequence
  Guide Sequence
cccagccccaccccaaacgca

SEQ ID NO: 12035 - RNA, 21 nt, Artificial Sequence
  Guide Sequence
cccagugagcacagguccugu

SEQ ID NO: 12036 - RNA, 21 nt, Artificial Sequence
  Guide Sequence
ccccaccagcacccugggcug

SEQ ID NO: 12037 - RNA, 21 nt, Artificial Sequence
  Guide Sequence
ccccagugagcacagguccug

SEQ ID NO: 12038 - RNA, 21 nt, Artificial Sequence
  Guide Sequence
cccccugggagcugacggggu

SEQ ID NO: 12039 - RNA, 21 nt, Artificial Sequence
  Guide Sequence
ccccgaaaaaucaauugggaa

SEQ ID NO: 12040 - RNA, 21 nt, Artificial Sequence
  Guide Sequence
ccccugggagcugacggggug

SEQ ID NO: 12041 - RNA, 21 nt, Artificial Sequence
  Guide Sequence
ccccuucccuccuggcuguga

SEQ ID NO: 12042 - RNA, 21 nt, Artificial Sequence
  Guide Sequence
cccgaaaaaucaauugggaaa

SEQ ID NO: 12043 - RNA, 21 nt, Artificial Sequence
  Guide Sequence
cccuagucaggugcauucuaa

SEQ ID NO: 12044 - RNA, 21 nt, Artificial Sequence
  Guide Sequence
cccuccagagaaggaaauaag

SEQ ID NO: 12045 - RNA, 21 nt, Artificial Sequence
  Guide Sequence
cccuccucugaccccaccagc

SEQ ID NO: 12046 - RNA, 21 nt, Artificial Sequence
  Guide Sequence
cccuccuggcugugagccagg

SEQ ID NO: 12047 - RNA, 21 nt, Artificial Sequence
  Guide Sequence
cccugggagcugacggggugu

SEQ ID NO: 12048 - RNA, 21 nt, Artificial Sequence
  Guide Sequence
cccugggcugugcccuccaga

SEQ ID NO: 12049 - RNA, 21 nt, Artificial Sequence
  Guide Sequence
cccuucccuccuggcugugag

SEQ ID NO: 12050 - RNA, 21 nt, Artificial Sequence
  Guide Sequence
ccgaaaaaucaauugggaaaa

SEQ ID NO: 12051 - RNA, 21 nt, Artificial Sequence
  Guide Sequence
ccgccagccaagucccacuga

SEQ ID NO: 12052 - RNA, 21 nt, Artificial Sequence
  Guide Sequence
ccuagucaggugcauucuaac

SEQ ID NO: 12053 - RNA, 21 nt, Artificial Sequence
  Guide Sequence
ccuccaaauuucuaagcagca

SEQ ID NO: 12054 - RNA, 21 nt, Artificial Sequence
  Guide Sequence
ccuccagagaaggaaauaagu

SEQ ID NO: 12055 - RNA, 21 nt, Artificial Sequence
  Guide Sequence
ccuccucugaccccaccagca

SEQ ID NO: 12056 - RNA, 21 nt, Artificial Sequence
  Guide Sequence
ccuccuggcugugagccaggc

SEQ ID NO: 12057 - RNA, 21 nt, Artificial Sequence
  Guide Sequence
ccucugaccccaccagcaccc

SEQ ID NO: 12058 - RNA, 21 nt, Artificial Sequence
  Guide Sequence
ccugccgccagccaaguccca

SEQ ID NO: 12059 - RNA, 21 nt, Artificial Sequence
  Guide Sequence
ccugccuccaaauuucuaagc

SEQ ID NO: 12060 - RNA, 21 nt, Artificial Sequence
  Guide Sequence
ccuggcugugagccaggcuuc

SEQ ID NO: 12061 - RNA, 21 nt, Artificial Sequence
  Guide Sequence
ccugggagcugacgggguguu

SEQ ID NO: 12062 - RNA, 21 nt, Artificial Sequence
  Guide Sequence
ccugggcugugcccuccagag

SEQ ID NO: 12063 - RNA, 21 nt, Artificial Sequence
  Guide Sequence
ccugucucugggcagcccucc

SEQ ID NO: 12064 - RNA, 21 nt, Artificial Sequence
  Guide Sequence
ccuguucucagccccuucccu

SEQ ID NO: 12065 - RNA, 21 nt, Artificial Sequence
  Guide Sequence
ccuucccuccuggcugugagc

SEQ ID NO: 12066 - RNA, 21 nt, Artificial Sequence
  Guide Sequence
ccuuucuccugucucugggca

SEQ ID NO: 12067 - RNA, 21 nt, Artificial Sequence
  Guide Sequence
cgaaaaaucaauugggaaaag

SEQ ID NO: 12068 - RNA, 21 nt, Artificial Sequence
  Guide Sequence
cgacuaagggacccagcccca

SEQ ID NO: 12069 - RNA, 21 nt, Artificial Sequence
  Guide Sequence
cgagcugggggcaguaguggg

SEQ ID NO: 12070 - RNA, 21 nt, Artificial Sequence
  Guide Sequence
cgccagccaagucccacugag

SEQ ID NO: 12071 - RNA, 21 nt, Artificial Sequence
  Guide Sequence
cgggguguuguuugugcaagc

SEQ ID NO: 12072 - RNA, 21 nt, Artificial Sequence
  Guide Sequence
cuaacgagcugggggcaguag

SEQ ID NO: 12073 - RNA, 21 nt, Artificial Sequence
  Guide Sequence
cuaagcagcaccaacaggaaa

SEQ ID NO: 12074 - RNA, 21 nt, Artificial Sequence
  Guide Sequence
cuaagggacccagccccaccc

SEQ ID NO: 12075 - RNA, 21 nt, Artificial Sequence
  Guide Sequence
cuagucaggugcauucuaacg

SEQ ID NO: 12076 - RNA, 21 nt, Artificial Sequence
  Guide Sequence
cucagccccuucccuccuggc

SEQ ID NO: 12077 - RNA, 21 nt, Artificial Sequence
  Guide Sequence
cuccaaauuucuaagcagcac

SEQ ID NO: 12078 - RNA, 21 nt, Artificial Sequence
  Guide Sequence
cuccagagaaggaaauaaguc

SEQ ID NO: 12079 - RNA, 21 nt, Artificial Sequence
  Guide Sequence
cuccucugaccccaccagcac

SEQ ID NO: 12080 - RNA, 21 nt, Artificial Sequence
  Guide Sequence
cuccuggcugugagccaggcu

SEQ ID NO: 12081 - RNA, 21 nt, Artificial Sequence
  Guide Sequence
cuccugucucugggcagcccu

SEQ ID NO: 12082 - RNA, 21 nt, Artificial Sequence
  Guide Sequence
cucugaccccaccagcacccu

SEQ ID NO: 12083 - RNA, 21 nt, Artificial Sequence
  Guide Sequence
cucugggcagcccuccucuga

SEQ ID NO: 12084 - RNA, 21 nt, Artificial Sequence
  Guide Sequence
cugaccccaccagcacccugg

SEQ ID NO: 12085 - RNA, 21 nt, Artificial Sequence
  Guide Sequence
cugacgggguguuguuugugc

SEQ ID NO: 12086 - RNA, 21 nt, Artificial Sequence
  Guide Sequence
cugagggcccuagucaggugc

SEQ ID NO: 12087 - RNA, 21 nt, Artificial Sequence
  Guide Sequence
cugccgccagccaagucccac

SEQ ID NO: 12088 - RNA, 21 nt, Artificial Sequence
  Guide Sequence
cugccuccaaauuucuaagca

SEQ ID NO: 12089 - RNA, 21 nt, Artificial Sequence
  Guide Sequence
cugggagcugacgggguguug

SEQ ID NO: 12090 - RNA, 21 nt, Artificial Sequence
  Guide Sequence
cugggauuacaggggugagac

SEQ ID NO: 12091 - RNA, 21 nt, Artificial Sequence
  Guide Sequence
cugggcagcccuccucugacc

SEQ ID NO: 12092 - RNA, 21 nt, Artificial Sequence
  Guide Sequence
cugggcugugcccuccagaga

SEQ ID NO: 12093 - RNA, 21 nt, Artificial Sequence
  Guide Sequence
cugggggcaguagugggagcc

SEQ ID NO: 12094 - RNA, 21 nt, Artificial Sequence
  Guide Sequence
cuguccuuucuccugucucug

SEQ ID NO: 12095 - RNA, 21 nt, Artificial Sequence
  Guide Sequence
cugucucugggcagcccuccu

SEQ ID NO: 12096 - RNA, 21 nt, Artificial Sequence
  Guide Sequence
cugugcccuccagagaaggaa

SEQ ID NO: 12097 - RNA, 21 nt, Artificial Sequence
  Guide Sequence
cuguggggagggaagggucau

SEQ ID NO: 12098 - RNA, 21 nt, Artificial Sequence
  Guide Sequence
cuguucucagccccuucccuc

SEQ ID NO: 12099 - RNA, 21 nt, Artificial Sequence
  Guide Sequence
cuucccuccuggcugugagcc

SEQ ID NO: 12100 - RNA, 21 nt, Artificial Sequence
  Guide Sequence
cuugggcagcgacuaagggac

SEQ ID NO: 12101 - RNA, 21 nt, Artificial Sequence
  Guide Sequence
cuuucuccugucucugggcag

SEQ ID NO: 12102 - RNA, 21 nt, Artificial Sequence
  Guide Sequence
cuuuggaaaugcuugggcagc

SEQ ID NO: 12103 - RNA, 21 nt, Artificial Sequence
  Guide Sequence
gaaaagucagacaggacuguc

SEQ ID NO: 12104 - RNA, 21 nt, Artificial Sequence
  Guide Sequence
gaaaugcuugggcagcgacua

SEQ ID NO: 12105 - RNA, 21 nt, Artificial Sequence
  Guide Sequence
gaagggucaugcaggccccag

SEQ ID NO: 12106 - RNA, 21 nt, Artificial Sequence
  Guide Sequence
gacaccacagccagccugccu

SEQ ID NO: 12107 - RNA, 21 nt, Artificial Sequence
  Guide Sequence
gacaggacuguccuuucuccu

SEQ ID NO: 12108 - RNA, 21 nt, Artificial Sequence
  Guide Sequence
gacccagccccaccccaaacg

SEQ ID NO: 12109 - RNA, 21 nt, Artificial Sequence
  Guide Sequence
gaccccaccagcacccugggc

SEQ ID NO: 12110 - RNA, 21 nt, Artificial Sequence
  Guide Sequence
gacgggguguuguuugugcaa

SEQ ID NO: 12111 - RNA, 21 nt, Artificial Sequence
  Guide Sequence
gacuaagggacccagccccac

SEQ ID NO: 12112 - RNA, 21 nt, Artificial Sequence
  Guide Sequence
gacuguccuuucuccugucuc

SEQ ID NO: 12113 - RNA, 21 nt, Artificial Sequence
  Guide Sequence
gagacaccacagccagccugc

SEQ ID NO: 12114 - RNA, 21 nt, Artificial Sequence
  Guide Sequence
gagcacagguccuguucucag

SEQ ID NO: 12115 - RNA, 21 nt, Artificial Sequence
  Guide Sequence
gagccccccugggagcugacg

SEQ ID NO: 12116 - RNA, 21 nt, Artificial Sequence
  Guide Sequence
gagcugacgggguguuguuug

SEQ ID NO: 12117 - RNA, 21 nt, Artificial Sequence
  Guide Sequence
gagcugggggcaguaguggga

SEQ ID NO: 12118 - RNA, 21 nt, Artificial Sequence
  Guide Sequence
gagggaagggucaugcaggcc

SEQ ID NO: 12119 - RNA, 21 nt, Artificial Sequence
  Guide Sequence
gagggcccuagucaggugcau

SEQ ID NO: 12120 - RNA, 21 nt, Artificial Sequence
  Guide Sequence
gaucaaaagccccgaaaaauc

SEQ ID NO: 12121 - RNA, 21 nt, Artificial Sequence
  Guide Sequence
gauuacaggggugagacacca

SEQ ID NO: 12122 - RNA, 21 nt, Artificial Sequence
  Guide Sequence
gcaagcauuuagaucaaaagc

SEQ ID NO: 12123 - RNA, 21 nt, Artificial Sequence
  Guide Sequence
gcacagguccuguucucagcc

SEQ ID NO: 12124 - RNA, 21 nt, Artificial Sequence
  Guide Sequence
gcaccaacaggaaaagucaga

SEQ ID NO: 12125 - RNA, 21 nt, Artificial Sequence
  Guide Sequence
gcacccugggcugugcccucc

SEQ ID NO: 12126 - RNA, 21 nt, Artificial Sequence
  Guide Sequence
gcagcaccaacaggaaaaguc

SEQ ID NO: 12127 - RNA, 21 nt, Artificial Sequence
  Guide Sequence
gcagcccuccucugaccccac

SEQ ID NO: 12128 - RNA, 21 nt, Artificial Sequence
  Guide Sequence
gcagcgacuaagggacccagc

SEQ ID NO: 12129 - RNA, 21 nt, Artificial Sequence
  Guide Sequence
gcaggccccagugagcacagg

SEQ ID NO: 12130 - RNA, 21 nt, Artificial Sequence
  Guide Sequence
gcaguagugggagccccccug

SEQ ID NO: 12131 - RNA, 21 nt, Artificial Sequence
  Guide Sequence
gcauucuaacgagcugggggc

SEQ ID NO: 12132 - RNA, 21 nt, Artificial Sequence
  Guide Sequence
gcauuuagaucaaaagccccg

SEQ ID NO: 12133 - RNA, 21 nt, Artificial Sequence
  Guide Sequence
gccaagucccacugagggccc

SEQ ID NO: 12134 - RNA, 21 nt, Artificial Sequence
  Guide Sequence
gccaccugccgccagccaagu

SEQ ID NO: 12135 - RNA, 21 nt, Artificial Sequence
  Guide Sequence
gccagccaagucccacugagg

SEQ ID NO: 12136 - RNA, 21 nt, Artificial Sequence
  Guide Sequence
gccagccugccuccaaauuuc

SEQ ID NO: 12137 - RNA, 21 nt, Artificial Sequence
  Guide Sequence
gccccagugagcacagguccu

SEQ ID NO: 12138 - RNA, 21 nt, Artificial Sequence
  Guide Sequence
gccccgaaaaaucaauuggga

SEQ ID NO: 12139 - RNA, 21 nt, Artificial Sequence
  Guide Sequence
gccccuucccuccuggcugug

SEQ ID NO: 12140 - RNA, 21 nt, Artificial Sequence
  Guide Sequence
gcccuagucaggugcauucua

SEQ ID NO: 12141 - RNA, 21 nt, Artificial Sequence
  Guide Sequence
gcccuccagagaaggaaauaa

SEQ ID NO: 12142 - RNA, 21 nt, Artificial Sequence
  Guide Sequence
gcccuccucugaccccaccag

SEQ ID NO: 12143 - RNA, 21 nt, Artificial Sequence
  Guide Sequence
gccgccagccaagucccacug

SEQ ID NO: 12144 - RNA, 21 nt, Artificial Sequence
  Guide Sequence
gccuccaaauuucuaagcagc

SEQ ID NO: 12145 - RNA, 21 nt, Artificial Sequence
  Guide Sequence
gccugccuccaaauuucuaag

SEQ ID NO: 12146 - RNA, 21 nt, Artificial Sequence
  Guide Sequence
gcgacuaagggacccagcccc

SEQ ID NO: 12147 - RNA, 21 nt, Artificial Sequence
  Guide Sequence
gcugacgggguguuguuugug

SEQ ID NO: 12148 - RNA, 21 nt, Artificial Sequence
  Guide Sequence
gcugggauuacaggggugaga

SEQ ID NO: 12149 - RNA, 21 nt, Artificial Sequence
  Guide Sequence
gcugggggcaguagugggagc

SEQ ID NO: 12150 - RNA, 21 nt, Artificial Sequence
  Guide Sequence
gcugugcccuccagagaagga

SEQ ID NO: 12151 - RNA, 21 nt, Artificial Sequence
  Guide Sequence
gcuugggcagcgacuaaggga

SEQ ID NO: 12152 - RNA, 21 nt, Artificial Sequence
  Guide Sequence
gcuuuggaaaugcuugggcag

SEQ ID NO: 12153 - RNA, 21 nt, Artificial Sequence
  Guide Sequence
ggaaaagucagacaggacugu

SEQ ID NO: 12154 - RNA, 21 nt, Artificial Sequence
  Guide Sequence
ggaaaugcuugggcagcgacu

SEQ ID NO: 12155 - RNA, 21 nt, Artificial Sequence
  Guide Sequence
ggaagggucaugcaggcccca

SEQ ID NO: 12156 - RNA, 21 nt, Artificial Sequence
  Guide Sequence
ggacccagccccaccccaaac

SEQ ID NO: 12157 - RNA, 21 nt, Artificial Sequence
  Guide Sequence
ggacuguccuuucuccugucu

SEQ ID NO: 12158 - RNA, 21 nt, Artificial Sequence
  Guide Sequence
ggagccccccugggagcugac

SEQ ID NO: 12159 - RNA, 21 nt, Artificial Sequence
  Guide Sequence
ggagcugacgggguguuguuu

SEQ ID NO: 12160 - RNA, 21 nt, Artificial Sequence
  Guide Sequence
ggagggaagggucaugcaggc

SEQ ID NO: 12161 - RNA, 21 nt, Artificial Sequence
  Guide Sequence
ggauuacaggggugagacacc

SEQ ID NO: 12162 - RNA, 21 nt, Artificial Sequence
  Guide Sequence
ggcagcccuccucugacccca

SEQ ID NO: 12163 - RNA, 21 nt, Artificial Sequence
  Guide Sequence
ggcagcgacuaagggacccag

SEQ ID NO: 12164 - RNA, 21 nt, Artificial Sequence
  Guide Sequence
ggcaguagugggagccccccu

SEQ ID NO: 12165 - RNA, 21 nt, Artificial Sequence
  Guide Sequence
ggccccagugagcacaggucc

SEQ ID NO: 12166 - RNA, 21 nt, Artificial Sequence
  Guide Sequence
ggcccuagucaggugcauucu

SEQ ID NO: 12167 - RNA, 21 nt, Artificial Sequence
  Guide Sequence
ggcugugcccuccagagaagg

SEQ ID NO: 12168 - RNA, 21 nt, Artificial Sequence
  Guide Sequence
ggcuuuggaaaugcuugggca

SEQ ID NO: 12169 - RNA, 21 nt, Artificial Sequence
  Guide Sequence
gggaagggucaugcaggcccc

SEQ ID NO: 12170 - RNA, 21 nt, Artificial Sequence
  Guide Sequence
gggacccagccccaccccaaa

SEQ ID NO: 12171 - RNA, 21 nt, Artificial Sequence
  Guide Sequence
gggagccccccugggagcuga

SEQ ID NO: 12172 - RNA, 21 nt, Artificial Sequence
  Guide Sequence
gggagcugacgggguguuguu

SEQ ID NO: 12173 - RNA, 21 nt, Artificial Sequence
  Guide Sequence
gggagggaagggucaugcagg

SEQ ID NO: 12174 - RNA, 21 nt, Artificial Sequence
  Guide Sequence
gggauuacaggggugagacac

SEQ ID NO: 12175 - RNA, 21 nt, Artificial Sequence
  Guide Sequence
gggcagcccuccucugacccc

SEQ ID NO: 12176 - RNA, 21 nt, Artificial Sequence
  Guide Sequence
gggcagcgacuaagggaccca

SEQ ID NO: 12177 - RNA, 21 nt, Artificial Sequence
  Guide Sequence
gggcaguagugggagcccccc

SEQ ID NO: 12178 - RNA, 21 nt, Artificial Sequence
  Guide Sequence
gggcccuagucaggugcauuc

SEQ ID NO: 12179 - RNA, 21 nt, Artificial Sequence
  Guide Sequence
gggcugugcccuccagagaag

SEQ ID NO: 12180 - RNA, 21 nt, Artificial Sequence
  Guide Sequence
gggcuuuggaaaugcuugggc

SEQ ID NO: 12181 - RNA, 21 nt, Artificial Sequence
  Guide Sequence
ggggagggaagggucaugcag

SEQ ID NO: 12182 - RNA, 21 nt, Artificial Sequence
  Guide Sequence
ggggcaguagugggagccccc

SEQ ID NO: 12183 - RNA, 21 nt, Artificial Sequence
  Guide Sequence
gggggcaguagugggagcccc

SEQ ID NO: 12184 - RNA, 21 nt, Artificial Sequence
  Guide Sequence
ggggugagacaccacagccag

SEQ ID NO: 12185 - RNA, 21 nt, Artificial Sequence
  Guide Sequence
gggguguuguuugugcaagca

SEQ ID NO: 12186 - RNA, 21 nt, Artificial Sequence
  Guide Sequence
gggucaugcaggccccaguga

SEQ ID NO: 12187 - RNA, 21 nt, Artificial Sequence
  Guide Sequence
gggugagacaccacagccagc

SEQ ID NO: 12188 - RNA, 21 nt, Artificial Sequence
  Guide Sequence
ggguguuguuugugcaagcau

SEQ ID NO: 12189 - RNA, 21 nt, Artificial Sequence
  Guide Sequence
ggucaugcaggccccagugag

SEQ ID NO: 12190 - RNA, 21 nt, Artificial Sequence
  Guide Sequence
gguccuguucucagccccuuc

SEQ ID NO: 12191 - RNA, 21 nt, Artificial Sequence
  Guide Sequence
ggugagacaccacagccagcc

SEQ ID NO: 12192 - RNA, 21 nt, Artificial Sequence
  Guide Sequence
ggugcauucuaacgagcuggg

SEQ ID NO: 12193 - RNA, 21 nt, Artificial Sequence
  Guide Sequence
gguguuguuugugcaagcauu

SEQ ID NO: 12194 - RNA, 21 nt, Artificial Sequence
  Guide Sequence
guagugggagccccccuggga

SEQ ID NO: 12195 - RNA, 21 nt, Artificial Sequence
  Guide Sequence
guaugggcuuuggaaaugcuu

SEQ ID NO: 12196 - RNA, 21 nt, Artificial Sequence
  Guide Sequence
gucagacaggacuguccuuuc

SEQ ID NO: 12197 - RNA, 21 nt, Artificial Sequence
  Guide Sequence
gucaggugcauucuaacgagc

SEQ ID NO: 12198 - RNA, 21 nt, Artificial Sequence
  Guide Sequence
gucaugcaggccccagugagc

SEQ ID NO: 12199 - RNA, 21 nt, Artificial Sequence
  Guide Sequence
gucccacugagggcccuaguc

SEQ ID NO: 12200 - RNA, 21 nt, Artificial Sequence
  Guide Sequence
guccuguucucagccccuucc

SEQ ID NO: 12201 - RNA, 21 nt, Artificial Sequence
  Guide Sequence
guccuuucuccugucucuggg

SEQ ID NO: 12202 - RNA, 21 nt, Artificial Sequence
  Guide Sequence
gucucugggcagcccuccucu

SEQ ID NO: 12203 - RNA, 21 nt, Artificial Sequence
  Guide Sequence
gugagacaccacagccagccu

SEQ ID NO: 12204 - RNA, 21 nt, Artificial Sequence
  Guide Sequence
gugagcacagguccuguucuc

SEQ ID NO: 12205 - RNA, 21 nt, Artificial Sequence
  Guide Sequence
gugcaagcauuuagaucaaaa

SEQ ID NO: 12206 - RNA, 21 nt, Artificial Sequence
  Guide Sequence
gugcauucuaacgagcugggg

SEQ ID NO: 12207 - RNA, 21 nt, Artificial Sequence
  Guide Sequence
gugcccuccagagaaggaaau

SEQ ID NO: 12208 - RNA, 21 nt, Artificial Sequence
  Guide Sequence
gugcugggauuacagggguga

SEQ ID NO: 12209 - RNA, 21 nt, Artificial Sequence
  Guide Sequence
gugggagccccccugggagcu

SEQ ID NO: 12210 - RNA, 21 nt, Artificial Sequence
  Guide Sequence
guggggagggaagggucaugc

SEQ ID NO: 12211 - RNA, 21 nt, Artificial Sequence
  Guide Sequence
guguuguuugugcaagcauuu

SEQ ID NO: 12212 - RNA, 21 nt, Artificial Sequence
  Guide Sequence
guucucagccccuucccuccu

SEQ ID NO: 12213 - RNA, 21 nt, Artificial Sequence
  Guide Sequence
guuguuugugcaagcauuuag

SEQ ID NO: 12214 - RNA, 21 nt, Artificial Sequence
  Guide Sequence
guuugugcaagcauuuagauc

SEQ ID NO: 12215 - RNA, 21 nt, Artificial Sequence
  Guide Sequence
uaacgagcugggggcaguagu

SEQ ID NO: 12216 - RNA, 21 nt, Artificial Sequence
  Guide Sequence
uaagcagcaccaacaggaaaa

SEQ ID NO: 12217 - RNA, 21 nt, Artificial Sequence
  Guide Sequence
uaagggacccagccccacccc

SEQ ID NO: 12218 - RNA, 21 nt, Artificial Sequence
  Guide Sequence
uacaggggugagacaccacag

SEQ ID NO: 12219 - RNA, 21 nt, Artificial Sequence
  Guide Sequence
uagaucaaaagccccgaaaaa

SEQ ID NO: 12220 - RNA, 21 nt, Artificial Sequence
  Guide Sequence
uagucaggugcauucuaacga

SEQ ID NO: 12221 - RNA, 21 nt, Artificial Sequence
  Guide Sequence
uagugggagccccccugggag

SEQ ID NO: 12222 - RNA, 21 nt, Artificial Sequence
  Guide Sequence
uaugggcuuuggaaaugcuug

SEQ ID NO: 12223 - RNA, 21 nt, Artificial Sequence
  Guide Sequence
ucaaaagccccgaaaaaucaa

SEQ ID NO: 12224 - RNA, 21 nt, Artificial Sequence
  Guide Sequence
ucagacaggacuguccuuucu

SEQ ID NO: 12225 - RNA, 21 nt, Artificial Sequence
  Guide Sequence
ucagccccuucccuccuggcu

SEQ ID NO: 12226 - RNA, 21 nt, Artificial Sequence
  Guide Sequence
ucaggugcauucuaacgagcu

SEQ ID NO: 12227 - RNA, 21 nt, Artificial Sequence
  Guide Sequence
ucaugcaggccccagugagca

SEQ ID NO: 12228 - RNA, 21 nt, Artificial Sequence
  Guide Sequence
uccaaauuucuaagcagcacc

SEQ ID NO: 12229 - RNA, 21 nt, Artificial Sequence
  Guide Sequence
uccagagaaggaaauaagucu

SEQ ID NO: 12230 - RNA, 21 nt, Artificial Sequence
  Guide Sequence
ucccacugagggcccuaguca

SEQ ID NO: 12231 - RNA, 21 nt, Artificial Sequence
  Guide Sequence
ucccuccuggcugugagccag

SEQ ID NO: 12232 - RNA, 21 nt, Artificial Sequence
  Guide Sequence
uccucugaccccaccagcacc

SEQ ID NO: 12233 - RNA, 21 nt, Artificial Sequence
  Guide Sequence
uccuggcugugagccaggcuu

SEQ ID NO: 12234 - RNA, 21 nt, Artificial Sequence
  Guide Sequence
uccugucucugggcagcccuc

SEQ ID NO: 12235 - RNA, 21 nt, Artificial Sequence
  Guide Sequence
uccuguucucagccccuuccc

SEQ ID NO: 12236 - RNA, 21 nt, Artificial Sequence
  Guide Sequence
uccuuucuccugucucugggc

SEQ ID NO: 12237 - RNA, 21 nt, Artificial Sequence
  Guide Sequence
ucuaacgagcugggggcagua

SEQ ID NO: 12238 - RNA, 21 nt, Artificial Sequence
  Guide Sequence
ucuaagcagcaccaacaggaa

SEQ ID NO: 12239 - RNA, 21 nt, Artificial Sequence
  Guide Sequence
ucucagccccuucccuccugg

SEQ ID NO: 12240 - RNA, 21 nt, Artificial Sequence
  Guide Sequence
ucuccugucucugggcagccc

SEQ ID NO: 12241 - RNA, 21 nt, Artificial Sequence
  Guide Sequence
ucucugggcagcccuccucug

SEQ ID NO: 12242 - RNA, 21 nt, Artificial Sequence
  Guide Sequence
ucugaccccaccagcacccug

SEQ ID NO: 12243 - RNA, 21 nt, Artificial Sequence
  Guide Sequence
ucugggcagcccuccucugac

SEQ ID NO: 12244 - RNA, 21 nt, Artificial Sequence
  Guide Sequence
ugaccccaccagcacccuggg

SEQ ID NO: 12245 - RNA, 21 nt, Artificial Sequence
  Guide Sequence
ugacgggguguuguuugugca

SEQ ID NO: 12246 - RNA, 21 nt, Artificial Sequence
  Guide Sequence
ugagacaccacagccagccug

SEQ ID NO: 12247 - RNA, 21 nt, Artificial Sequence
  Guide Sequence
ugagcacagguccuguucuca

SEQ ID NO: 12248 - RNA, 21 nt, Artificial Sequence
  Guide Sequence
ugagggcccuagucaggugca

SEQ ID NO: 12249 - RNA, 21 nt, Artificial Sequence
  Guide Sequence
ugcaagcauuuagaucaaaag

SEQ ID NO: 12250 - RNA, 21 nt, Artificial Sequence
  Guide Sequence
ugcaggccccagugagcacag

SEQ ID NO: 12251 - RNA, 21 nt, Artificial Sequence
  Guide Sequence
ugcauucuaacgagcuggggg

SEQ ID NO: 12252 - RNA, 21 nt, Artificial Sequence
  Guide Sequence
ugcccuccagagaaggaaaua

SEQ ID NO: 12253 - RNA, 21 nt, Artificial Sequence
  Guide Sequence
ugccgccagccaagucccacu

SEQ ID NO: 12254 - RNA, 21 nt, Artificial Sequence
  Guide Sequence
ugccuccaaauuucuaagcag

SEQ ID NO: 12255 - RNA, 21 nt, Artificial Sequence
  Guide Sequence
ugcugggauuacaggggugag

SEQ ID NO: 12256 - RNA, 21 nt, Artificial Sequence
  Guide Sequence
ugcuugggcagcgacuaaggg

SEQ ID NO: 12257 - RNA, 21 nt, Artificial Sequence
  Guide Sequence
uggaaaugcuugggcagcgac

SEQ ID NO: 12258 - RNA, 21 nt, Artificial Sequence
  Guide Sequence
ugggagccccccugggagcug

SEQ ID NO: 12259 - RNA, 21 nt, Artificial Sequence
  Guide Sequence
ugggagcugacgggguguugu

SEQ ID NO: 12260 - RNA, 21 nt, Artificial Sequence
  Guide Sequence
ugggauuacaggggugagaca

SEQ ID NO: 12261 - RNA, 21 nt, Artificial Sequence
  Guide Sequence
ugggcagcccuccucugaccc

SEQ ID NO: 12262 - RNA, 21 nt, Artificial Sequence
  Guide Sequence
ugggcagcgacuaagggaccc

SEQ ID NO: 12263 - RNA, 21 nt, Artificial Sequence
  Guide Sequence
ugggcugugcccuccagagaa

SEQ ID NO: 12264 - RNA, 21 nt, Artificial Sequence
  Guide Sequence
ugggcuuuggaaaugcuuggg

SEQ ID NO: 12265 - RNA, 21 nt, Artificial Sequence
  Guide Sequence
uggggagggaagggucaugca

SEQ ID NO: 12266 - RNA, 21 nt, Artificial Sequence
  Guide Sequence
ugggggcaguagugggagccc

SEQ ID NO: 12267 - RNA, 21 nt, Artificial Sequence
  Guide Sequence
uguccuuucuccugucucugg

SEQ ID NO: 12268 - RNA, 21 nt, Artificial Sequence
  Guide Sequence
ugucucugggcagcccuccuc

SEQ ID NO: 12269 - RNA, 21 nt, Artificial Sequence
  Guide Sequence
ugugcaagcauuuagaucaaa

SEQ ID NO: 12270 - RNA, 21 nt, Artificial Sequence
  Guide Sequence
ugugcccuccagagaaggaaa

SEQ ID NO: 12271 - RNA, 21 nt, Artificial Sequence
  Guide Sequence
uguggggagggaagggucaug

SEQ ID NO: 12272 - RNA, 21 nt, Artificial Sequence
  Guide Sequence
uguucucagccccuucccucc

SEQ ID NO: 12273 - RNA, 21 nt, Artificial Sequence
  Guide Sequence
uguuguuugugcaagcauuua

SEQ ID NO: 12274 - RNA, 21 nt, Artificial Sequence
  Guide Sequence
uguuugugcaagcauuuagau

SEQ ID NO: 12275 - RNA, 21 nt, Artificial Sequence
  Guide Sequence
uuacaggggugagacaccaca

SEQ ID NO: 12276 - RNA, 21 nt, Artificial Sequence
  Guide Sequence
uuagaucaaaagccccgaaaa

SEQ ID NO: 12277 - RNA, 21 nt, Artificial Sequence
  Guide Sequence
uucccuccuggcugugagcca

SEQ ID NO: 12278 - RNA, 21 nt, Artificial Sequence
  Guide Sequence
uucuaacgagcugggggcagu

SEQ ID NO: 12279 - RNA, 21 nt, Artificial Sequence
  Guide Sequence
uucuaagcagcaccaacagga

SEQ ID NO: 12280 - RNA, 21 nt, Artificial Sequence
  Guide Sequence
uucucagccccuucccuccug

SEQ ID NO: 12281 - RNA, 21 nt, Artificial Sequence
  Guide Sequence
uucuccugucucugggcagcc

SEQ ID NO: 12282 - RNA, 21 nt, Artificial Sequence
  Guide Sequence
uuggaaaugcuugggcagcga

SEQ ID NO: 12283 - RNA, 21 nt, Artificial Sequence
  Guide Sequence
uugggcagcgacuaagggacc

SEQ ID NO: 12284 - RNA, 21 nt, Artificial Sequence
  Guide Sequence
uugugcaagcauuuagaucaa

SEQ ID NO: 12285 - RNA, 21 nt, Artificial Sequence
  Guide Sequence
uuguuugugcaagcauuuaga

SEQ ID NO: 12286 - RNA, 21 nt, Artificial Sequence
  Guide Sequence
uuuagaucaaaagccccgaaa

SEQ ID NO: 12287 - RNA, 21 nt, Artificial Sequence
  Guide Sequence
uuucuaagcagcaccaacagg

SEQ ID NO: 12288 - RNA, 21 nt, Artificial Sequence
  Guide Sequence
uuucuccugucucugggcagc

SEQ ID NO: 12289 - RNA, 21 nt, Artificial Sequence
  Guide Sequence
uuuggaaaugcuugggcagcg

SEQ ID NO: 12290 - RNA, 21 nt, Artificial Sequence
  Guide Sequence
uuugugcaagcauuuagauca

SEQ ID NO: 12291 - RNA, 22 nt, Artificial Sequence
  Guide Sequence
aaaagccccgaaaaaucaauug

SEQ ID NO: 12292 - RNA, 22 nt, Artificial Sequence
  Guide Sequence
aaaagucagacaggacuguccu

SEQ ID NO: 12293 - RNA, 22 nt, Artificial Sequence
  Guide Sequence
aaagccaccugccgccagccaa

SEQ ID NO: 12294 - RNA, 22 nt, Artificial Sequence
  Guide Sequence
aaagccccgaaaaaucaauugg

SEQ ID NO: 12295 - RNA, 22 nt, Artificial Sequence
  Guide Sequence
aaaguaugggcuuuggaaaugc

SEQ ID NO: 12296 - RNA, 22 nt, Artificial Sequence
  Guide Sequence
aaagucagacaggacuguccuu

SEQ ID NO: 12297 - RNA, 22 nt, Artificial Sequence
  Guide Sequence
aaagugcugggauuacaggggu

SEQ ID NO: 12298 - RNA, 22 nt, Artificial Sequence
  Guide Sequence
aaaugcuugggcagcgacuaag

SEQ ID NO: 12299 - RNA, 22 nt, Artificial Sequence
  Guide Sequence
aaauuucuaagcagcaccaaca

SEQ ID NO: 12300 - RNA, 22 nt, Artificial Sequence
  Guide Sequence
aacaggaaaagucagacaggac

SEQ ID NO: 12301 - RNA, 22 nt, Artificial Sequence
  Guide Sequence
aacgagcugggggcaguagugg

SEQ ID NO: 12302 - RNA, 22 nt, Artificial Sequence
  Guide Sequence
aagcagcaccaacaggaaaagu

SEQ ID NO: 12303 - RNA, 22 nt, Artificial Sequence
  Guide Sequence
aagcauuuagaucaaaagcccc

SEQ ID NO: 12304 - RNA, 22 nt, Artificial Sequence
  Guide Sequence
aagccaccugccgccagccaag

SEQ ID NO: 12305 - RNA, 22 nt, Artificial Sequence
  Guide Sequence
aagccccgaaaaaucaauuggg

SEQ ID NO: 12306 - RNA, 22 nt, Artificial Sequence
  Guide Sequence
aagggacccagccccaccccaa

SEQ ID NO: 12307 - RNA, 22 nt, Artificial Sequence
  Guide Sequence
aagggucaugcaggccccagug

SEQ ID NO: 12308 - RNA, 22 nt, Artificial Sequence
  Guide Sequence
aaguaugggcuuuggaaaugcu

SEQ ID NO: 12309 - RNA, 22 nt, Artificial Sequence
  Guide Sequence
aagucagacaggacuguccuuu

SEQ ID NO: 12310 - RNA, 22 nt, Artificial Sequence
  Guide Sequence
aagucccacugagggcccuagu

SEQ ID NO: 12311 - RNA, 22 nt, Artificial Sequence
  Guide Sequence
aagugcugggauuacaggggug

SEQ ID NO: 12312 - RNA, 22 nt, Artificial Sequence
  Guide Sequence
aaugcuugggcagcgacuaagg

SEQ ID NO: 12313 - RNA, 22 nt, Artificial Sequence
  Guide Sequence
aauuucuaagcagcaccaacag

SEQ ID NO: 12314 - RNA, 22 nt, Artificial Sequence
  Guide Sequence
acaccacagccagccugccucc

SEQ ID NO: 12315 - RNA, 22 nt, Artificial Sequence
  Guide Sequence
acagccagccugccuccaaauu

SEQ ID NO: 12316 - RNA, 22 nt, Artificial Sequence
  Guide Sequence
acaggaaaagucagacaggacu

SEQ ID NO: 12317 - RNA, 22 nt, Artificial Sequence
  Guide Sequence
acaggacuguccuuucuccugu

SEQ ID NO: 12318 - RNA, 22 nt, Artificial Sequence
  Guide Sequence
acaggggugagacaccacagcc

SEQ ID NO: 12319 - RNA, 22 nt, Artificial Sequence
  Guide Sequence
acagguccuguucucagccccu

SEQ ID NO: 12320 - RNA, 22 nt, Artificial Sequence
  Guide Sequence
accaacaggaaaagucagacag

SEQ ID NO: 12321 - RNA, 22 nt, Artificial Sequence
  Guide Sequence
accacagccagccugccuccaa

SEQ ID NO: 12322 - RNA, 22 nt, Artificial Sequence
  Guide Sequence
accagcacccugggcugugccc

SEQ ID NO: 12323 - RNA, 22 nt, Artificial Sequence
  Guide Sequence
acccagccccaccccaaacgca

SEQ ID NO: 12324 - RNA, 22 nt, Artificial Sequence
  Guide Sequence
accccaccagcacccugggcug

SEQ ID NO: 12325 - RNA, 22 nt, Artificial Sequence
  Guide Sequence
acccugggcugugcccuccaga

SEQ ID NO: 12326 - RNA, 22 nt, Artificial Sequence
  Guide Sequence
accugccgccagccaaguccca

SEQ ID NO: 12327 - RNA, 22 nt, Artificial Sequence
  Guide Sequence
acgagcugggggcaguaguggg

SEQ ID NO: 12328 - RNA, 22 nt, Artificial Sequence
  Guide Sequence
acgggguguuguuugugcaagc

SEQ ID NO: 12329 - RNA, 22 nt, Artificial Sequence
  Guide Sequence
acuaagggacccagccccaccc

SEQ ID NO: 12330 - RNA, 22 nt, Artificial Sequence
  Guide Sequence
acugagggcccuagucaggugc

SEQ ID NO: 12331 - RNA, 22 nt, Artificial Sequence
  Guide Sequence
acuguccuuucuccugucucug

SEQ ID NO: 12332 - RNA, 22 nt, Artificial Sequence
  Guide Sequence
agacaccacagccagccugccu

SEQ ID NO: 12333 - RNA, 22 nt, Artificial Sequence
  Guide Sequence
agacaggacuguccuuucuccu

SEQ ID NO: 12334 - RNA, 22 nt, Artificial Sequence
  Guide Sequence
agaucaaaagccccgaaaaauc

SEQ ID NO: 12335 - RNA, 22 nt, Artificial Sequence
  Guide Sequence
agcacagguccuguucucagcc

SEQ ID NO: 12336 - RNA, 22 nt, Artificial Sequence
  Guide Sequence
agcaccaacaggaaaagucaga

SEQ ID NO: 12337 - RNA, 22 nt, Artificial Sequence
  Guide Sequence
agcacccugggcugugcccucc

SEQ ID NO: 12338 - RNA, 22 nt, Artificial Sequence
  Guide Sequence
agcagcaccaacaggaaaaguc

SEQ ID NO: 12339 - RNA, 22 nt, Artificial Sequence
  Guide Sequence
agcauuuagaucaaaagccccg

SEQ ID NO: 12340 - RNA, 22 nt, Artificial Sequence
  Guide Sequence
agccaagucccacugagggccc

SEQ ID NO: 12341 - RNA, 22 nt, Artificial Sequence
  Guide Sequence
agccaccugccgccagccaagu

SEQ ID NO: 12342 - RNA, 22 nt, Artificial Sequence
  Guide Sequence
agccagccugccuccaaauuuc

SEQ ID NO: 12343 - RNA, 22 nt, Artificial Sequence
  Guide Sequence
agccccccugggagcugacggg

SEQ ID NO: 12344 - RNA, 22 nt, Artificial Sequence
  Guide Sequence
agccccgaaaaaucaauuggga

SEQ ID NO: 12345 - RNA, 22 nt, Artificial Sequence
  Guide Sequence
agccccuucccuccuggcugug

SEQ ID NO: 12346 - RNA, 22 nt, Artificial Sequence
  Guide Sequence
agcccuccucugaccccaccag

SEQ ID NO: 12347 - RNA, 22 nt, Artificial Sequence
  Guide Sequence
agccugccuccaaauuucuaag

SEQ ID NO: 12348 - RNA, 22 nt, Artificial Sequence
  Guide Sequence
agcgacuaagggacccagcccc

SEQ ID NO: 12349 - RNA, 22 nt, Artificial Sequence
  Guide Sequence
agcugacgggguguuguuugug

SEQ ID NO: 12350 - RNA, 22 nt, Artificial Sequence
  Guide Sequence
agcugggggcaguagugggagc

SEQ ID NO: 12351 - RNA, 22 nt, Artificial Sequence
  Guide Sequence
aggaaaagucagacaggacugu

SEQ ID NO: 12352 - RNA, 22 nt, Artificial Sequence
  Guide Sequence
aggacuguccuuucuccugucu

SEQ ID NO: 12353 - RNA, 22 nt, Artificial Sequence
  Guide Sequence
aggccccagugagcacaggucc

SEQ ID NO: 12354 - RNA, 22 nt, Artificial Sequence
  Guide Sequence
agggaagggucaugcaggcccc

SEQ ID NO: 12355 - RNA, 22 nt, Artificial Sequence
  Guide Sequence
agggacccagccccaccccaaa

SEQ ID NO: 12356 - RNA, 22 nt, Artificial Sequence
  Guide Sequence
agggcccuagucaggugcauuc

SEQ ID NO: 12357 - RNA, 22 nt, Artificial Sequence
  Guide Sequence
aggggugagacaccacagccag

SEQ ID NO: 12358 - RNA, 22 nt, Artificial Sequence
  Guide Sequence
agggucaugcaggccccaguga

SEQ ID NO: 12359 - RNA, 22 nt, Artificial Sequence
  Guide Sequence
agguccuguucucagccccuuc

SEQ ID NO: 12360 - RNA, 22 nt, Artificial Sequence
  Guide Sequence
aggugcauucuaacgagcuggg

SEQ ID NO: 12361 - RNA, 22 nt, Artificial Sequence
  Guide Sequence
aguagugggagccccccuggga

SEQ ID NO: 12362 - RNA, 22 nt, Artificial Sequence
  Guide Sequence
aguaugggcuuuggaaaugcuu

SEQ ID NO: 12363 - RNA, 22 nt, Artificial Sequence
  Guide Sequence
agucagacaggacuguccuuuc

SEQ ID NO: 12364 - RNA, 22 nt, Artificial Sequence
  Guide Sequence
agucaggugcauucuaacgagc

SEQ ID NO: 12365 - RNA, 22 nt, Artificial Sequence
  Guide Sequence
agucccacugagggcccuaguc

SEQ ID NO: 12366 - RNA, 22 nt, Artificial Sequence
  Guide Sequence
agugagcacagguccuguucuc

SEQ ID NO: 12367 - RNA, 22 nt, Artificial Sequence
  Guide Sequence
agugcugggauuacagggguga

SEQ ID NO: 12368 - RNA, 22 nt, Artificial Sequence
  Guide Sequence
agugggagccccccugggagcu

SEQ ID NO: 12369 - RNA, 22 nt, Artificial Sequence
  Guide Sequence
aucaaaagccccgaaaaaucaa

SEQ ID NO: 12370 - RNA, 22 nt, Artificial Sequence
  Guide Sequence
augcaggccccagugagcacag

SEQ ID NO: 12371 - RNA, 22 nt, Artificial Sequence
  Guide Sequence
augcuugggcagcgacuaaggg

SEQ ID NO: 12372 - RNA, 22 nt, Artificial Sequence
  Guide Sequence
augggcuuuggaaaugcuuggg

SEQ ID NO: 12373 - RNA, 22 nt, Artificial Sequence
  Guide Sequence
auuacaggggugagacaccaca

SEQ ID NO: 12374 - RNA, 22 nt, Artificial Sequence
  Guide Sequence
auucuaacgagcugggggcagu

SEQ ID NO: 12375 - RNA, 22 nt, Artificial Sequence
  Guide Sequence
auuuagaucaaaagccccgaaa

SEQ ID NO: 12376 - RNA, 22 nt, Artificial Sequence
  Guide Sequence
auuucuaagcagcaccaacagg

SEQ ID NO: 12377 - RNA, 22 nt, Artificial Sequence
  Guide Sequence
caaaagccccgaaaaaucaauu

SEQ ID NO: 12378 - RNA, 22 nt, Artificial Sequence
  Guide Sequence
caaagugcugggauuacagggg

SEQ ID NO: 12379 - RNA, 22 nt, Artificial Sequence
  Guide Sequence
caaauuucuaagcagcaccaac

SEQ ID NO: 12380 - RNA, 22 nt, Artificial Sequence
  Guide Sequence
caacaggaaaagucagacagga

SEQ ID NO: 12381 - RNA, 22 nt, Artificial Sequence
  Guide Sequence
caagcauuuagaucaaaagccc

SEQ ID NO: 12382 - RNA, 22 nt, Artificial Sequence
  Guide Sequence
caagucccacugagggcccuag

SEQ ID NO: 12383 - RNA, 22 nt, Artificial Sequence
  Guide Sequence
cacagccagccugccuccaaau

SEQ ID NO: 12384 - RNA, 22 nt, Artificial Sequence
  Guide Sequence
cacagguccuguucucagcccc

SEQ ID NO: 12385 - RNA, 22 nt, Artificial Sequence
  Guide Sequence
caccaacaggaaaagucagaca

SEQ ID NO: 12386 - RNA, 22 nt, Artificial Sequence
  Guide Sequence
caccacagccagccugccucca

SEQ ID NO: 12387 - RNA, 22 nt, Artificial Sequence
  Guide Sequence
caccagcacccugggcugugcc

SEQ ID NO: 12388 - RNA, 22 nt, Artificial Sequence
  Guide Sequence
cacccugggcugugcccuccag

SEQ ID NO: 12389 - RNA, 22 nt, Artificial Sequence
  Guide Sequence
caccugccgccagccaaguccc

SEQ ID NO: 12390 - RNA, 22 nt, Artificial Sequence
  Guide Sequence
cacugagggcccuagucaggug

SEQ ID NO: 12391 - RNA, 22 nt, Artificial Sequence
  Guide Sequence
cagacaggacuguccuuucucc

SEQ ID NO: 12392 - RNA, 22 nt, Artificial Sequence
  Guide Sequence
cagagaaggaaauaagucuacc

SEQ ID NO: 12393 - RNA, 22 nt, Artificial Sequence
  Guide Sequence
cagcaccaacaggaaaagucag

SEQ ID NO: 12394 - RNA, 22 nt, Artificial Sequence
  Guide Sequence
cagcacccugggcugugcccuc

SEQ ID NO: 12395 - RNA, 22 nt, Artificial Sequence
  Guide Sequence
cagccaagucccacugagggcc

SEQ ID NO: 12396 - RNA, 22 nt, Artificial Sequence
  Guide Sequence
cagccagccugccuccaaauuu

SEQ ID NO: 12397 - RNA, 22 nt, Artificial Sequence
  Guide Sequence
cagccccuucccuccuggcugu

SEQ ID NO: 12398 - RNA, 22 nt, Artificial Sequence
  Guide Sequence
cagcccuccucugaccccacca

SEQ ID NO: 12399 - RNA, 22 nt, Artificial Sequence
  Guide Sequence
cagccugccuccaaauuucuaa

SEQ ID NO: 12400 - RNA, 22 nt, Artificial Sequence
  Guide Sequence
cagcgacuaagggacccagccc

SEQ ID NO: 12401 - RNA, 22 nt, Artificial Sequence
  Guide Sequence
caggaaaagucagacaggacug

SEQ ID NO: 12402 - RNA, 22 nt, Artificial Sequence
  Guide Sequence
caggacuguccuuucuccuguc

SEQ ID NO: 12403 - RNA, 22 nt, Artificial Sequence
  Guide Sequence
caggccccagugagcacagguc

SEQ ID NO: 12404 - RNA, 22 nt, Artificial Sequence
  Guide Sequence
caggggugagacaccacagcca

SEQ ID NO: 12405 - RNA, 22 nt, Artificial Sequence
  Guide Sequence
cagguccuguucucagccccuu

SEQ ID NO: 12406 - RNA, 22 nt, Artificial Sequence
  Guide Sequence
caggugcauucuaacgagcugg

SEQ ID NO: 12407 - RNA, 22 nt, Artificial Sequence
  Guide Sequence
caguagugggagccccccuggg

SEQ ID NO: 12408 - RNA, 22 nt, Artificial Sequence
  Guide Sequence
cagugagcacagguccuguucu

SEQ ID NO: 12409 - RNA, 22 nt, Artificial Sequence
  Guide Sequence
caugcaggccccagugagcaca

SEQ ID NO: 12410 - RNA, 22 nt, Artificial Sequence
  Guide Sequence
cauucuaacgagcugggggcag

SEQ ID NO: 12411 - RNA, 22 nt, Artificial Sequence
  Guide Sequence
cauuuagaucaaaagccccgaa

SEQ ID NO: 12412 - RNA, 22 nt, Artificial Sequence
  Guide Sequence
ccaaagugcugggauuacaggg

SEQ ID NO: 12413 - RNA, 22 nt, Artificial Sequence
  Guide Sequence
ccaaauuucuaagcagcaccaa

SEQ ID NO: 12414 - RNA, 22 nt, Artificial Sequence
  Guide Sequence
ccaacaggaaaagucagacagg

SEQ ID NO: 12415 - RNA, 22 nt, Artificial Sequence
  Guide Sequence
ccaagucccacugagggcccua

SEQ ID NO: 12416 - RNA, 22 nt, Artificial Sequence
  Guide Sequence
ccacagccagccugccuccaaa

SEQ ID NO: 12417 - RNA, 22 nt, Artificial Sequence
  Guide Sequence
ccaccagcacccugggcugugc

SEQ ID NO: 12418 - RNA, 22 nt, Artificial Sequence
  Guide Sequence
ccaccugccgccagccaagucc

SEQ ID NO: 12419 - RNA, 22 nt, Artificial Sequence
  Guide Sequence
ccacugagggcccuagucaggu

SEQ ID NO: 12420 - RNA, 22 nt, Artificial Sequence
  Guide Sequence
ccagagaaggaaauaagucuac

SEQ ID NO: 12421 - RNA, 22 nt, Artificial Sequence
  Guide Sequence
ccagcacccugggcugugcccu

SEQ ID NO: 12422 - RNA, 22 nt, Artificial Sequence
  Guide Sequence
ccagccaagucccacugagggc

SEQ ID NO: 12423 - RNA, 22 nt, Artificial Sequence
  Guide Sequence
ccagccccaccccaaacgcagg

SEQ ID NO: 12424 - RNA, 22 nt, Artificial Sequence
  Guide Sequence
ccagccugccuccaaauuucua

SEQ ID NO: 12425 - RNA, 22 nt, Artificial Sequence
  Guide Sequence
ccagugagcacagguccuguuc

SEQ ID NO: 12426 - RNA, 22 nt, Artificial Sequence
  Guide Sequence
cccaaagugcugggauuacagg

SEQ ID NO: 12427 - RNA, 22 nt, Artificial Sequence
  Guide Sequence
cccaccagcacccugggcugug

SEQ ID NO: 12428 - RNA, 22 nt, Artificial Sequence
  Guide Sequence
cccacugagggcccuagucagg

SEQ ID NO: 12429 - RNA, 22 nt, Artificial Sequence
  Guide Sequence
cccagccccaccccaaacgcag

SEQ ID NO: 12430 - RNA, 22 nt, Artificial Sequence
  Guide Sequence
cccagugagcacagguccuguu

SEQ ID NO: 12431 - RNA, 22 nt, Artificial Sequence
  Guide Sequence
ccccaccagcacccugggcugu

SEQ ID NO: 12432 - RNA, 22 nt, Artificial Sequence
  Guide Sequence
ccccagugagcacagguccugu

SEQ ID NO: 12433 - RNA, 22 nt, Artificial Sequence
  Guide Sequence
ccccccugggagcugacggggu

SEQ ID NO: 12434 - RNA, 22 nt, Artificial Sequence
  Guide Sequence
cccccugggagcugacggggug

SEQ ID NO: 12435 - RNA, 22 nt, Artificial Sequence
  Guide Sequence
ccccgaaaaaucaauugggaaa

SEQ ID NO: 12436 - RNA, 22 nt, Artificial Sequence
  Guide Sequence
ccccugggagcugacggggugu

SEQ ID NO: 12437 - RNA, 22 nt, Artificial Sequence
  Guide Sequence
ccccuucccuccuggcugugag

SEQ ID NO: 12438 - RNA, 22 nt, Artificial Sequence
  Guide Sequence
cccgaaaaaucaauugggaaaa

SEQ ID NO: 12439 - RNA, 22 nt, Artificial Sequence
  Guide Sequence
cccuagucaggugcauucuaac

SEQ ID NO: 12440 - RNA, 22 nt, Artificial Sequence
  Guide Sequence
cccuccagagaaggaaauaagu

SEQ ID NO: 12441 - RNA, 22 nt, Artificial Sequence
  Guide Sequence
cccuccucugaccccaccagca

SEQ ID NO: 12442 - RNA, 22 nt, Artificial Sequence
  Guide Sequence
cccuccuggcugugagccaggc

SEQ ID NO: 12443 - RNA, 22 nt, Artificial Sequence
  Guide Sequence
cccugggagcugacgggguguu

SEQ ID NO: 12444 - RNA, 22 nt, Artificial Sequence
  Guide Sequence
cccugggcugugcccuccagag

SEQ ID NO: 12445 - RNA, 22 nt, Artificial Sequence
  Guide Sequence
cccuucccuccuggcugugagc

SEQ ID NO: 12446 - RNA, 22 nt, Artificial Sequence
  Guide Sequence
ccgaaaaaucaauugggaaaag

SEQ ID NO: 12447 - RNA, 22 nt, Artificial Sequence
  Guide Sequence
ccgccagccaagucccacugag

SEQ ID NO: 12448 - RNA, 22 nt, Artificial Sequence
  Guide Sequence
ccuagucaggugcauucuaacg

SEQ ID NO: 12449 - RNA, 22 nt, Artificial Sequence
  Guide Sequence
ccuccaaauuucuaagcagcac

SEQ ID NO: 12450 - RNA, 22 nt, Artificial Sequence
  Guide Sequence
ccuccagagaaggaaauaaguc

SEQ ID NO: 12451 - RNA, 22 nt, Artificial Sequence
  Guide Sequence
ccuccucugaccccaccagcac

SEQ ID NO: 12452 - RNA, 22 nt, Artificial Sequence
  Guide Sequence
ccuccuggcugugagccaggcu

SEQ ID NO: 12453 - RNA, 22 nt, Artificial Sequence
  Guide Sequence
ccucugaccccaccagcacccu

SEQ ID NO: 12454 - RNA, 22 nt, Artificial Sequence
  Guide Sequence
ccugccgccagccaagucccac

SEQ ID NO: 12455 - RNA, 22 nt, Artificial Sequence
  Guide Sequence
ccugccuccaaauuucuaagca

SEQ ID NO: 12456 - RNA, 22 nt, Artificial Sequence
  Guide Sequence
ccugggagcugacgggguguug

SEQ ID NO: 12457 - RNA, 22 nt, Artificial Sequence
  Guide Sequence
ccugggcugugcccuccagaga

SEQ ID NO: 12458 - RNA, 22 nt, Artificial Sequence
  Guide Sequence
ccugucucugggcagcccuccu

SEQ ID NO: 12459 - RNA, 22 nt, Artificial Sequence
  Guide Sequence
ccuguucucagccccuucccuc

SEQ ID NO: 12460 - RNA, 22 nt, Artificial Sequence
  Guide Sequence
ccuucccuccuggcugugagcc

SEQ ID NO: 12461 - RNA, 22 nt, Artificial Sequence
  Guide Sequence
ccuuucuccugucucugggcag

SEQ ID NO: 12462 - RNA, 22 nt, Artificial Sequence
  Guide Sequence
cgaaaaaucaauugggaaaagu

SEQ ID NO: 12463 - RNA, 22 nt, Artificial Sequence
  Guide Sequence
cgacuaagggacccagccccac

SEQ ID NO: 12464 - RNA, 22 nt, Artificial Sequence
  Guide Sequence
cgagcugggggcaguaguggga

SEQ ID NO: 12465 - RNA, 22 nt, Artificial Sequence
  Guide Sequence
cgccagccaagucccacugagg

SEQ ID NO: 12466 - RNA, 22 nt, Artificial Sequence
  Guide Sequence
cgggguguuguuugugcaagca

SEQ ID NO: 12467 - RNA, 22 nt, Artificial Sequence
  Guide Sequence
cuaacgagcugggggcaguagu

SEQ ID NO: 12468 - RNA, 22 nt, Artificial Sequence
  Guide Sequence
cuaagcagcaccaacaggaaaa

SEQ ID NO: 12469 - RNA, 22 nt, Artificial Sequence
  Guide Sequence
cuaagggacccagccccacccc

SEQ ID NO: 12470 - RNA, 22 nt, Artificial Sequence
  Guide Sequence
cuagucaggugcauucuaacga

SEQ ID NO: 12471 - RNA, 22 nt, Artificial Sequence
  Guide Sequence
cucagccccuucccuccuggcu

SEQ ID NO: 12472 - RNA, 22 nt, Artificial Sequence
  Guide Sequence
cuccaaauuucuaagcagcacc

SEQ ID NO: 12473 - RNA, 22 nt, Artificial Sequence
  Guide Sequence
cuccagagaaggaaauaagucu

SEQ ID NO: 12474 - RNA, 22 nt, Artificial Sequence
  Guide Sequence
cuccucugaccccaccagcacc

SEQ ID NO: 12475 - RNA, 22 nt, Artificial Sequence
  Guide Sequence
cuccuggcugugagccaggcuu

SEQ ID NO: 12476 - RNA, 22 nt, Artificial Sequence
  Guide Sequence
cuccugucucugggcagcccuc

SEQ ID NO: 12477 - RNA, 22 nt, Artificial Sequence
  Guide Sequence
cucugaccccaccagcacccug

SEQ ID NO: 12478 - RNA, 22 nt, Artificial Sequence
  Guide Sequence
cucugggcagcccuccucugac

SEQ ID NO: 12479 - RNA, 22 nt, Artificial Sequence
  Guide Sequence
cugaccccaccagcacccuggg

SEQ ID NO: 12480 - RNA, 22 nt, Artificial Sequence
  Guide Sequence
cugacgggguguuguuugugca

SEQ ID NO: 12481 - RNA, 22 nt, Artificial Sequence
  Guide Sequence
cugagggcccuagucaggugca

SEQ ID NO: 12482 - RNA, 22 nt, Artificial Sequence
  Guide Sequence
cugccgccagccaagucccacu

SEQ ID NO: 12483 - RNA, 22 nt, Artificial Sequence
  Guide Sequence
cugccuccaaauuucuaagcag

SEQ ID NO: 12484 - RNA, 22 nt, Artificial Sequence
  Guide Sequence
cugggagcugacgggguguugu

SEQ ID NO: 12485 - RNA, 22 nt, Artificial Sequence
  Guide Sequence
cugggauuacaggggugagaca

SEQ ID NO: 12486 - RNA, 22 nt, Artificial Sequence
  Guide Sequence
cugggcagcccuccucugaccc

SEQ ID NO: 12487 - RNA, 22 nt, Artificial Sequence
  Guide Sequence
cugggcugugcccuccagagaa

SEQ ID NO: 12488 - RNA, 22 nt, Artificial Sequence
  Guide Sequence
cugggggcaguagugggagccc

SEQ ID NO: 12489 - RNA, 22 nt, Artificial Sequence
  Guide Sequence
cuguccuuucuccugucucugg

SEQ ID NO: 12490 - RNA, 22 nt, Artificial Sequence
  Guide Sequence
cugucucugggcagcccuccuc

SEQ ID NO: 12491 - RNA, 22 nt, Artificial Sequence
  Guide Sequence
cugugcccuccagagaaggaaa

SEQ ID NO: 12492 - RNA, 22 nt, Artificial Sequence
  Guide Sequence
cuguggggagggaagggucaug

SEQ ID NO: 12493 - RNA, 22 nt, Artificial Sequence
  Guide Sequence
cuguucucagccccuucccucc

SEQ ID NO: 12494 - RNA, 22 nt, Artificial Sequence
  Guide Sequence
cuucccuccuggcugugagcca

SEQ ID NO: 12495 - RNA, 22 nt, Artificial Sequence
  Guide Sequence
cuugggcagcgacuaagggacc

SEQ ID NO: 12496 - RNA, 22 nt, Artificial Sequence
  Guide Sequence
cuuucuccugucucugggcagc

SEQ ID NO: 12497 - RNA, 22 nt, Artificial Sequence
  Guide Sequence
cuuuggaaaugcuugggcagcg

SEQ ID NO: 12498 - RNA, 22 nt, Artificial Sequence
  Guide Sequence
gaaaagucagacaggacugucc

SEQ ID NO: 12499 - RNA, 22 nt, Artificial Sequence
  Guide Sequence
gaaaugcuugggcagcgacuaa

SEQ ID NO: 12500 - RNA, 22 nt, Artificial Sequence
  Guide Sequence
gaagggucaugcaggccccagu

SEQ ID NO: 12501 - RNA, 22 nt, Artificial Sequence
  Guide Sequence
gacaccacagccagccugccuc

SEQ ID NO: 12502 - RNA, 22 nt, Artificial Sequence
  Guide Sequence
gacaggacuguccuuucuccug

SEQ ID NO: 12503 - RNA, 22 nt, Artificial Sequence
  Guide Sequence
gacccagccccaccccaaacgc

SEQ ID NO: 12504 - RNA, 22 nt, Artificial Sequence
  Guide Sequence
gaccccaccagcacccugggcu

SEQ ID NO: 12505 - RNA, 22 nt, Artificial Sequence
  Guide Sequence
gacgggguguuguuugugcaag

SEQ ID NO: 12506 - RNA, 22 nt, Artificial Sequence
  Guide Sequence
gacuaagggacccagccccacc

SEQ ID NO: 12507 - RNA, 22 nt, Artificial Sequence
  Guide Sequence
gacuguccuuucuccugucucu

SEQ ID NO: 12508 - RNA, 22 nt, Artificial Sequence
  Guide Sequence
gagacaccacagccagccugcc

SEQ ID NO: 12509 - RNA, 22 nt, Artificial Sequence
  Guide Sequence
gagcacagguccuguucucagc

SEQ ID NO: 12510 - RNA, 22 nt, Artificial Sequence
  Guide Sequence
gagccccccugggagcugacgg

SEQ ID NO: 12511 - RNA, 22 nt, Artificial Sequence
  Guide Sequence
gagcugacgggguguuguuugu

SEQ ID NO: 12512 - RNA, 22 nt, Artificial Sequence
  Guide Sequence
gagcugggggcaguagugggag

SEQ ID NO: 12513 - RNA, 22 nt, Artificial Sequence
  Guide Sequence
gagggaagggucaugcaggccc

SEQ ID NO: 12514 - RNA, 22 nt, Artificial Sequence
  Guide Sequence
gagggcccuagucaggugcauu

SEQ ID NO: 12515 - RNA, 22 nt, Artificial Sequence
  Guide Sequence
gaucaaaagccccgaaaaauca

SEQ ID NO: 12516 - RNA, 22 nt, Artificial Sequence
  Guide Sequence
gauuacaggggugagacaccac

SEQ ID NO: 12517 - RNA, 22 nt, Artificial Sequence
  Guide Sequence
gcaagcauuuagaucaaaagcc

SEQ ID NO: 12518 - RNA, 22 nt, Artificial Sequence
  Guide Sequence
gcacagguccuguucucagccc

SEQ ID NO: 12519 - RNA, 22 nt, Artificial Sequence
  Guide Sequence
gcaccaacaggaaaagucagac

SEQ ID NO: 12520 - RNA, 22 nt, Artificial Sequence
  Guide Sequence
gcacccugggcugugcccucca

SEQ ID NO: 12521 - RNA, 22 nt, Artificial Sequence
  Guide Sequence
gcagcaccaacaggaaaaguca

SEQ ID NO: 12522 - RNA, 22 nt, Artificial Sequence
  Guide Sequence
gcagcccuccucugaccccacc

SEQ ID NO: 12523 - RNA, 22 nt, Artificial Sequence
  Guide Sequence
gcagcgacuaagggacccagcc

SEQ ID NO: 12524 - RNA, 22 nt, Artificial Sequence
  Guide Sequence
gcaggccccagugagcacaggu

SEQ ID NO: 12525 - RNA, 22 nt, Artificial Sequence
  Guide Sequence
gcaguagugggagccccccugg

SEQ ID NO: 12526 - RNA, 22 nt, Artificial Sequence
  Guide Sequence
gcauucuaacgagcugggggca

SEQ ID NO: 12527 - RNA, 22 nt, Artificial Sequence
  Guide Sequence
gcauuuagaucaaaagccccga

SEQ ID NO: 12528 - RNA, 22 nt, Artificial Sequence
  Guide Sequence
gccaagucccacugagggcccu

SEQ ID NO: 12529 - RNA, 22 nt, Artificial Sequence
  Guide Sequence
gccaccugccgccagccaaguc

SEQ ID NO: 12530 - RNA, 22 nt, Artificial Sequence
  Guide Sequence
gccagccaagucccacugaggg

SEQ ID NO: 12531 - RNA, 22 nt, Artificial Sequence
  Guide Sequence
gccagccugccuccaaauuucu

SEQ ID NO: 12532 - RNA, 22 nt, Artificial Sequence
  Guide Sequence
gccccagugagcacagguccug

SEQ ID NO: 12533 - RNA, 22 nt, Artificial Sequence
  Guide Sequence
gccccgaaaaaucaauugggaa

SEQ ID NO: 12534 - RNA, 22 nt, Artificial Sequence
  Guide Sequence
gccccuucccuccuggcuguga

SEQ ID NO: 12535 - RNA, 22 nt, Artificial Sequence
  Guide Sequence
gcccuagucaggugcauucuaa

SEQ ID NO: 12536 - RNA, 22 nt, Artificial Sequence
  Guide Sequence
gcccuccagagaaggaaauaag

SEQ ID NO: 12537 - RNA, 22 nt, Artificial Sequence
  Guide Sequence
gcccuccucugaccccaccagc

SEQ ID NO: 12538 - RNA, 22 nt, Artificial Sequence
  Guide Sequence
gccgccagccaagucccacuga

SEQ ID NO: 12539 - RNA, 22 nt, Artificial Sequence
  Guide Sequence
gccuccaaauuucuaagcagca

SEQ ID NO: 12540 - RNA, 22 nt, Artificial Sequence
  Guide Sequence
gccugccuccaaauuucuaagc

SEQ ID NO: 12541 - RNA, 22 nt, Artificial Sequence
  Guide Sequence
gcgacuaagggacccagcccca

SEQ ID NO: 12542 - RNA, 22 nt, Artificial Sequence
  Guide Sequence
gcugacgggguguuguuugugc

SEQ ID NO: 12543 - RNA, 22 nt, Artificial Sequence
  Guide Sequence
gcugggauuacaggggugagac

SEQ ID NO: 12544 - RNA, 22 nt, Artificial Sequence
  Guide Sequence
gcugggggcaguagugggagcc

SEQ ID NO: 12545 - RNA, 22 nt, Artificial Sequence
  Guide Sequence
gcugugcccuccagagaaggaa

SEQ ID NO: 12546 - RNA, 22 nt, Artificial Sequence
  Guide Sequence
gcuugggcagcgacuaagggac

SEQ ID NO: 12547 - RNA, 22 nt, Artificial Sequence
  Guide Sequence
gcuuuggaaaugcuugggcagc

SEQ ID NO: 12548 - RNA, 22 nt, Artificial Sequence
  Guide Sequence
ggaaaagucagacaggacuguc

SEQ ID NO: 12549 - RNA, 22 nt, Artificial Sequence
  Guide Sequence
ggaaaugcuugggcagcgacua

SEQ ID NO: 12550 - RNA, 22 nt, Artificial Sequence
  Guide Sequence
ggaagggucaugcaggccccag

SEQ ID NO: 12551 - RNA, 22 nt, Artificial Sequence
  Guide Sequence
ggacccagccccaccccaaacg

SEQ ID NO: 12552 - RNA, 22 nt, Artificial Sequence
  Guide Sequence
ggacuguccuuucuccugucuc

SEQ ID NO: 12553 - RNA, 22 nt, Artificial Sequence
  Guide Sequence
ggagccccccugggagcugacg

SEQ ID NO: 12554 - RNA, 22 nt, Artificial Sequence
  Guide Sequence
ggagcugacgggguguuguuug

SEQ ID NO: 12555 - RNA, 22 nt, Artificial Sequence
  Guide Sequence
ggagggaagggucaugcaggcc

SEQ ID NO: 12556 - RNA, 22 nt, Artificial Sequence
  Guide Sequence
ggauuacaggggugagacacca

SEQ ID NO: 12557 - RNA, 22 nt, Artificial Sequence
  Guide Sequence
ggcagcccuccucugaccccac

SEQ ID NO: 12558 - RNA, 22 nt, Artificial Sequence
  Guide Sequence
ggcagcgacuaagggacccagc

SEQ ID NO: 12559 - RNA, 22 nt, Artificial Sequence
  Guide Sequence
ggcaguagugggagccccccug

SEQ ID NO: 12560 - RNA, 22 nt, Artificial Sequence
  Guide Sequence
ggccccagugagcacagguccu

SEQ ID NO: 12561 - RNA, 22 nt, Artificial Sequence
  Guide Sequence
ggcccuagucaggugcauucua

SEQ ID NO: 12562 - RNA, 22 nt, Artificial Sequence
  Guide Sequence
ggcugugcccuccagagaagga

SEQ ID NO: 12563 - RNA, 22 nt, Artificial Sequence
  Guide Sequence
ggcuuuggaaaugcuugggcag

SEQ ID NO: 12564 - RNA, 22 nt, Artificial Sequence
  Guide Sequence
gggaagggucaugcaggcccca

SEQ ID NO: 12565 - RNA, 22 nt, Artificial Sequence
  Guide Sequence
gggacccagccccaccccaaac

SEQ ID NO: 12566 - RNA, 22 nt, Artificial Sequence
  Guide Sequence
gggagccccccugggagcugac

SEQ ID NO: 12567 - RNA, 22 nt, Artificial Sequence
  Guide Sequence
gggagcugacgggguguuguuu

SEQ ID NO: 12568 - RNA, 22 nt, Artificial Sequence
  Guide Sequence
gggagggaagggucaugcaggc

SEQ ID NO: 12569 - RNA, 22 nt, Artificial Sequence
  Guide Sequence
gggauuacaggggugagacacc

SEQ ID NO: 12570 - RNA, 22 nt, Artificial Sequence
  Guide Sequence
gggcagcccuccucugacccca

SEQ ID NO: 12571 - RNA, 22 nt, Artificial Sequence
  Guide Sequence
gggcagcgacuaagggacccag

SEQ ID NO: 12572 - RNA, 22 nt, Artificial Sequence
  Guide Sequence
gggcaguagugggagccccccu

SEQ ID NO: 12573 - RNA, 22 nt, Artificial Sequence
  Guide Sequence
gggcccuagucaggugcauucu

SEQ ID NO: 12574 - RNA, 22 nt, Artificial Sequence
  Guide Sequence
gggcugugcccuccagagaagg

SEQ ID NO: 12575 - RNA, 22 nt, Artificial Sequence
  Guide Sequence
gggcuuuggaaaugcuugggca

SEQ ID NO: 12576 - RNA, 22 nt, Artificial Sequence
  Guide Sequence
ggggagggaagggucaugcagg

SEQ ID NO: 12577 - RNA, 22 nt, Artificial Sequence
  Guide Sequence
ggggcaguagugggagcccccc

SEQ ID NO: 12578 - RNA, 22 nt, Artificial Sequence
  Guide Sequence
gggggcaguagugggagccccc

SEQ ID NO: 12579 - RNA, 22 nt, Artificial Sequence
  Guide Sequence
ggggugagacaccacagccagc

SEQ ID NO: 12580 - RNA, 22 nt, Artificial Sequence
  Guide Sequence
gggguguuguuugugcaagcau

SEQ ID NO: 12581 - RNA, 22 nt, Artificial Sequence
  Guide Sequence
gggucaugcaggccccagugag

SEQ ID NO: 12582 - RNA, 22 nt, Artificial Sequence
  Guide Sequence
gggugagacaccacagccagcc

SEQ ID NO: 12583 - RNA, 22 nt, Artificial Sequence
  Guide Sequence
ggguguuguuugugcaagcauu

SEQ ID NO: 12584 - RNA, 22 nt, Artificial Sequence
  Guide Sequence
ggucaugcaggccccagugagc

SEQ ID NO: 12585 - RNA, 22 nt, Artificial Sequence
  Guide Sequence
gguccuguucucagccccuucc

SEQ ID NO: 12586 - RNA, 22 nt, Artificial Sequence
  Guide Sequence
ggugagacaccacagccagccu

SEQ ID NO: 12587 - RNA, 22 nt, Artificial Sequence
  Guide Sequence
ggugcauucuaacgagcugggg

SEQ ID NO: 12588 - RNA, 22 nt, Artificial Sequence
  Guide Sequence
gguguuguuugugcaagcauuu

SEQ ID NO: 12589 - RNA, 22 nt, Artificial Sequence
  Guide Sequence
guagugggagccccccugggag

SEQ ID NO: 12590 - RNA, 22 nt, Artificial Sequence
  Guide Sequence
guaugggcuuuggaaaugcuug

SEQ ID NO: 12591 - RNA, 22 nt, Artificial Sequence
  Guide Sequence
gucagacaggacuguccuuucu

SEQ ID NO: 12592 - RNA, 22 nt, Artificial Sequence
  Guide Sequence
gucaggugcauucuaacgagcu

SEQ ID NO: 12593 - RNA, 22 nt, Artificial Sequence
  Guide Sequence
gucaugcaggccccagugagca

SEQ ID NO: 12594 - RNA, 22 nt, Artificial Sequence
  Guide Sequence
gucccacugagggcccuaguca

SEQ ID NO: 12595 - RNA, 22 nt, Artificial Sequence
  Guide Sequence
guccuguucucagccccuuccc

SEQ ID NO: 12596 - RNA, 22 nt, Artificial Sequence
  Guide Sequence
guccuuucuccugucucugggc

SEQ ID NO: 12597 - RNA, 22 nt, Artificial Sequence
  Guide Sequence
gucucugggcagcccuccucug

SEQ ID NO: 12598 - RNA, 22 nt, Artificial Sequence
  Guide Sequence
gugagacaccacagccagccug

SEQ ID NO: 12599 - RNA, 22 nt, Artificial Sequence
  Guide Sequence
gugagcacagguccuguucuca

SEQ ID NO: 12600 - RNA, 22 nt, Artificial Sequence
  Guide Sequence
gugcaagcauuuagaucaaaag

SEQ ID NO: 12601 - RNA, 22 nt, Artificial Sequence
  Guide Sequence
gugcauucuaacgagcuggggg

SEQ ID NO: 12602 - RNA, 22 nt, Artificial Sequence
  Guide Sequence
gugcccuccagagaaggaaaua

SEQ ID NO: 12603 - RNA, 22 nt, Artificial Sequence
  Guide Sequence
gugcugggauuacaggggugag

SEQ ID NO: 12604 - RNA, 22 nt, Artificial Sequence
  Guide Sequence
gugggagccccccugggagcug

SEQ ID NO: 12605 - RNA, 22 nt, Artificial Sequence
  Guide Sequence
guggggagggaagggucaugca

SEQ ID NO: 12606 - RNA, 22 nt, Artificial Sequence
  Guide Sequence
guguuguuugugcaagcauuua

SEQ ID NO: 12607 - RNA, 22 nt, Artificial Sequence
  Guide Sequence
guucucagccccuucccuccug

SEQ ID NO: 12608 - RNA, 22 nt, Artificial Sequence
  Guide Sequence
guuguuugugcaagcauuuaga

SEQ ID NO: 12609 - RNA, 22 nt, Artificial Sequence
  Guide Sequence
guuugugcaagcauuuagauca

SEQ ID NO: 12610 - RNA, 22 nt, Artificial Sequence
  Guide Sequence
uaacgagcugggggcaguagug

SEQ ID NO: 12611 - RNA, 22 nt, Artificial Sequence
  Guide Sequence
uaagcagcaccaacaggaaaag

SEQ ID NO: 12612 - RNA, 22 nt, Artificial Sequence
  Guide Sequence
uaagggacccagccccacccca

SEQ ID NO: 12613 - RNA, 22 nt, Artificial Sequence
  Guide Sequence
uacaggggugagacaccacagc

SEQ ID NO: 12614 - RNA, 22 nt, Artificial Sequence
  Guide Sequence
uagaucaaaagccccgaaaaau

SEQ ID NO: 12615 - RNA, 22 nt, Artificial Sequence
  Guide Sequence
uagucaggugcauucuaacgag

SEQ ID NO: 12616 - RNA, 22 nt, Artificial Sequence
  Guide Sequence
uagugggagccccccugggagc

SEQ ID NO: 12617 - RNA, 22 nt, Artificial Sequence
  Guide Sequence
uaugggcuuuggaaaugcuugg

SEQ ID NO: 12618 - RNA, 22 nt, Artificial Sequence
  Guide Sequence
ucaaaagccccgaaaaaucaau

SEQ ID NO: 12619 - RNA, 22 nt, Artificial Sequence
  Guide Sequence
ucagacaggacuguccuuucuc

SEQ ID NO: 12620 - RNA, 22 nt, Artificial Sequence
  Guide Sequence
ucagccccuucccuccuggcug

SEQ ID NO: 12621 - RNA, 22 nt, Artificial Sequence
  Guide Sequence
ucaggugcauucuaacgagcug

SEQ ID NO: 12622 - RNA, 22 nt, Artificial Sequence
  Guide Sequence
ucaugcaggccccagugagcac

SEQ ID NO: 12623 - RNA, 22 nt, Artificial Sequence
  Guide Sequence
uccaaauuucuaagcagcacca

SEQ ID NO: 12624 - RNA, 22 nt, Artificial Sequence
  Guide Sequence
uccagagaaggaaauaagucua

SEQ ID NO: 12625 - RNA, 22 nt, Artificial Sequence
  Guide Sequence
ucccacugagggcccuagucag

SEQ ID NO: 12626 - RNA, 22 nt, Artificial Sequence
  Guide Sequence
ucccuccuggcugugagccagg

SEQ ID NO: 12627 - RNA, 22 nt, Artificial Sequence
  Guide Sequence
uccucugaccccaccagcaccc

SEQ ID NO: 12628 - RNA, 22 nt, Artificial Sequence
  Guide Sequence
uccuggcugugagccaggcuuc

SEQ ID NO: 12629 - RNA, 22 nt, Artificial Sequence
  Guide Sequence
uccugucucugggcagcccucc

SEQ ID NO: 12630 - RNA, 22 nt, Artificial Sequence
  Guide Sequence
uccuguucucagccccuucccu

SEQ ID NO: 12631 - RNA, 22 nt, Artificial Sequence
  Guide Sequence
uccuuucuccugucucugggca

SEQ ID NO: 12632 - RNA, 22 nt, Artificial Sequence
  Guide Sequence
ucuaacgagcugggggcaguag

SEQ ID NO: 12633 - RNA, 22 nt, Artificial Sequence
  Guide Sequence
ucuaagcagcaccaacaggaaa

SEQ ID NO: 12634 - RNA, 22 nt, Artificial Sequence
  Guide Sequence
ucucagccccuucccuccuggc

SEQ ID NO: 12635 - RNA, 22 nt, Artificial Sequence
  Guide Sequence
ucuccugucucugggcagcccu

SEQ ID NO: 12636 - RNA, 22 nt, Artificial Sequence
  Guide Sequence
ucucugggcagcccuccucuga

SEQ ID NO: 12637 - RNA, 22 nt, Artificial Sequence
  Guide Sequence
ucugaccccaccagcacccugg

SEQ ID NO: 12638 - RNA, 22 nt, Artificial Sequence
  Guide Sequence
ucugggcagcccuccucugacc

SEQ ID NO: 12639 - RNA, 22 nt, Artificial Sequence
  Guide Sequence
ugaccccaccagcacccugggc

SEQ ID NO: 12640 - RNA, 22 nt, Artificial Sequence
  Guide Sequence
ugacgggguguuguuugugcaa

SEQ ID NO: 12641 - RNA, 22 nt, Artificial Sequence
  Guide Sequence
ugagacaccacagccagccugc

SEQ ID NO: 12642 - RNA, 22 nt, Artificial Sequence
  Guide Sequence
ugagcacagguccuguucucag

SEQ ID NO: 12643 - RNA, 22 nt, Artificial Sequence
  Guide Sequence
ugagggcccuagucaggugcau

SEQ ID NO: 12644 - RNA, 22 nt, Artificial Sequence
  Guide Sequence
ugcaagcauuuagaucaaaagc

SEQ ID NO: 12645 - RNA, 22 nt, Artificial Sequence
  Guide Sequence
ugcaggccccagugagcacagg

SEQ ID NO: 12646 - RNA, 22 nt, Artificial Sequence
  Guide Sequence
ugcauucuaacgagcugggggc

SEQ ID NO: 12647 - RNA, 22 nt, Artificial Sequence
  Guide Sequence
ugcccuccagagaaggaaauaa

SEQ ID NO: 12648 - RNA, 22 nt, Artificial Sequence
  Guide Sequence
ugccgccagccaagucccacug

SEQ ID NO: 12649 - RNA, 22 nt, Artificial Sequence
  Guide Sequence
ugccuccaaauuucuaagcagc

SEQ ID NO: 12650 - RNA, 22 nt, Artificial Sequence
  Guide Sequence
ugcugggauuacaggggugaga

SEQ ID NO: 12651 - RNA, 22 nt, Artificial Sequence
  Guide Sequence
ugcuugggcagcgacuaaggga

SEQ ID NO: 12652 - RNA, 22 nt, Artificial Sequence
  Guide Sequence
uggaaaugcuugggcagcgacu

SEQ ID NO: 12653 - RNA, 22 nt, Artificial Sequence
  Guide Sequence
ugggagccccccugggagcuga

SEQ ID NO: 12654 - RNA, 22 nt, Artificial Sequence
  Guide Sequence
ugggagcugacgggguguuguu

SEQ ID NO: 12655 - RNA, 22 nt, Artificial Sequence
  Guide Sequence
ugggauuacaggggugagacac

SEQ ID NO: 12656 - RNA, 22 nt, Artificial Sequence
  Guide Sequence
ugggcagcccuccucugacccc

SEQ ID NO: 12657 - RNA, 22 nt, Artificial Sequence
  Guide Sequence
ugggcagcgacuaagggaccca

SEQ ID NO: 12658 - RNA, 22 nt, Artificial Sequence
  Guide Sequence
ugggcugugcccuccagagaag

SEQ ID NO: 12659 - RNA, 22 nt, Artificial Sequence
  Guide Sequence
ugggcuuuggaaaugcuugggc

SEQ ID NO: 12660 - RNA, 22 nt, Artificial Sequence
  Guide Sequence
uggggagggaagggucaugcag

SEQ ID NO: 12661 - RNA, 22 nt, Artificial Sequence
  Guide Sequence
ugggggcaguagugggagcccc

SEQ ID NO: 12662 - RNA, 22 nt, Artificial Sequence
  Guide Sequence
uguccuuucuccugucucuggg

SEQ ID NO: 12663 - RNA, 22 nt, Artificial Sequence
  Guide Sequence
ugucucugggcagcccuccucu

SEQ ID NO: 12664 - RNA, 22 nt, Artificial Sequence
  Guide Sequence
ugugcaagcauuuagaucaaaa

SEQ ID NO: 12665 - RNA, 22 nt, Artificial Sequence
  Guide Sequence
ugugcccuccagagaaggaaau

SEQ ID NO: 12666 - RNA, 22 nt, Artificial Sequence
  Guide Sequence
uguggggagggaagggucaugc

SEQ ID NO: 12667 - RNA, 22 nt, Artificial Sequence
  Guide Sequence
uguucucagccccuucccuccu

SEQ ID NO: 12668 - RNA, 22 nt, Artificial Sequence
  Guide Sequence
uguuguuugugcaagcauuuag

SEQ ID NO: 12669 - RNA, 22 nt, Artificial Sequence
  Guide Sequence
uguuugugcaagcauuuagauc

SEQ ID NO: 12670 - RNA, 22 nt, Artificial Sequence
  Guide Sequence
uuacaggggugagacaccacag

SEQ ID NO: 12671 - RNA, 22 nt, Artificial Sequence
  Guide Sequence
uuagaucaaaagccccgaaaaa

SEQ ID NO: 12672 - RNA, 22 nt, Artificial Sequence
  Guide Sequence
uucccuccuggcugugagccag

SEQ ID NO: 12673 - RNA, 22 nt, Artificial Sequence
  Guide Sequence
uucuaacgagcugggggcagua

SEQ ID NO: 12674 - RNA, 22 nt, Artificial Sequence
  Guide Sequence
uucuaagcagcaccaacaggaa

SEQ ID NO: 12675 - RNA, 22 nt, Artificial Sequence
  Guide Sequence
uucucagccccuucccuccugg

SEQ ID NO: 12676 - RNA, 22 nt, Artificial Sequence
  Guide Sequence
uucuccugucucugggcagccc

SEQ ID NO: 12677 - RNA, 22 nt, Artificial Sequence
  Guide Sequence
uuggaaaugcuugggcagcgac

SEQ ID NO: 12678 - RNA, 22 nt, Artificial Sequence
  Guide Sequence
uugggcagcgacuaagggaccc

SEQ ID NO: 12679 - RNA, 22 nt, Artificial Sequence
  Guide Sequence
uugugcaagcauuuagaucaaa

SEQ ID NO: 12680 - RNA, 22 nt, Artificial Sequence
  Guide Sequence
uuguuugugcaagcauuuagau

SEQ ID NO: 12681 - RNA, 22 nt, Artificial Sequence
  Guide Sequence
uuuagaucaaaagccccgaaaa

SEQ ID NO: 12682 - RNA, 22 nt, Artificial Sequence
  Guide Sequence
uuucuaagcagcaccaacagga

SEQ ID NO: 12683 - RNA, 22 nt, Artificial Sequence
  Guide Sequence
uuucuccugucucugggcagcc

SEQ ID NO: 12684 - RNA, 22 nt, Artificial Sequence
  Guide Sequence
uuuggaaaugcuugggcagcga

SEQ ID NO: 12685 - RNA, 22 nt, Artificial Sequence
  Guide Sequence
uuugugcaagcauuuagaucaa

SEQ ID NO: 12686 - RNA, 20 nt, Artificial Sequence
  Guide Sequence
aaaaguuagucaaggggguc

SEQ ID NO: 12687 - RNA, 20 nt, Artificial Sequence
  Guide Sequence
aaaccagaccaggcacagug

SEQ ID NO: 12688 - RNA, 20 nt, Artificial Sequence
  Guide Sequence
aaaguuagucaagggggucu

SEQ ID NO: 12689 - RNA, 20 nt, Artificial Sequence
  Guide Sequence
aaaugcaucuaucucaucua

SEQ ID NO: 12690 - RNA, 20 nt, Artificial Sequence
  Guide Sequence
aacaaucaagagacccaaac

SEQ ID NO: 12691 - RNA, 20 nt, Artificial Sequence
  Guide Sequence
aacagcuaccuaacuaccca

SEQ ID NO: 12692 - RNA, 20 nt, Artificial Sequence
  Guide Sequence
aaccagaccaggcacagugg

SEQ ID NO: 12693 - RNA, 20 nt, Artificial Sequence
  Guide Sequence
aacccagaaggcggagauug

SEQ ID NO: 12694 - RNA, 20 nt, Artificial Sequence
  Guide Sequence
aacuacccaccacagguggg

SEQ ID NO: 12695 - RNA, 20 nt, Artificial Sequence
  Guide Sequence
aagaacaaucaagagaccca

SEQ ID NO: 12696 - RNA, 20 nt, Artificial Sequence
  Guide Sequence
aagagacccaaaccagacca

SEQ ID NO: 12697 - RNA, 20 nt, Artificial Sequence
  Guide Sequence
aagagacucaaaaaagagac

SEQ ID NO: 12698 - RNA, 20 nt, Artificial Sequence
  Guide Sequence
aagcgccucuuccucaugcc

SEQ ID NO: 12699 - RNA, 20 nt, Artificial Sequence
  Guide Sequence
aaggcggagauugcagugag

SEQ ID NO: 12700 - RNA, 20 nt, Artificial Sequence
  Guide Sequence
aagggaagggaggaagcgcc

SEQ ID NO: 12701 - RNA, 20 nt, Artificial Sequence
  Guide Sequence
aagggaggaagcgccucuuc

SEQ ID NO: 12702 - RNA, 20 nt, Artificial Sequence
  Guide Sequence
aagggaguggccaggcacag

SEQ ID NO: 12703 - RNA, 20 nt, Artificial Sequence
  Guide Sequence
aagggggucucugcuggggc

SEQ ID NO: 12704 - RNA, 20 nt, Artificial Sequence
  Guide Sequence
aaguuagucaagggggucuc

SEQ ID NO: 12705 - RNA, 20 nt, Artificial Sequence
  Guide Sequence
aauaaaaguuagucaagggg

SEQ ID NO: 12706 - RNA, 20 nt, Artificial Sequence
  Guide Sequence
aaucaagagacccaaaccag

SEQ ID NO: 12707 - RNA, 20 nt, Artificial Sequence
  Guide Sequence
aaucacccugggcccccuca

SEQ ID NO: 12708 - RNA, 20 nt, Artificial Sequence
  Guide Sequence
aaucauuugaacccagaagg

SEQ ID NO: 12709 - RNA, 20 nt, Artificial Sequence
  Guide Sequence
aaucccagcacucuggaagg

SEQ ID NO: 12710 - RNA, 20 nt, Artificial Sequence
  Guide Sequence
aaucccagcacuuugggagg

SEQ ID NO: 12711 - RNA, 20 nt, Artificial Sequence
  Guide Sequence
aaugcaucuaucucaucuaa

SEQ ID NO: 12712 - RNA, 20 nt, Artificial Sequence
  Guide Sequence
aauucucacuguggguauuc

SEQ ID NO: 12713 - RNA, 20 nt, Artificial Sequence
  Guide Sequence
acaaucaagagacccaaacc

SEQ ID NO: 12714 - RNA, 20 nt, Artificial Sequence
  Guide Sequence
acaccuuuaaucccagcacu

SEQ ID NO: 12715 - RNA, 20 nt, Artificial Sequence
  Guide Sequence
acacuuguaaucccagcacu

SEQ ID NO: 12716 - RNA, 20 nt, Artificial Sequence
  Guide Sequence
acagagcaagagacucaaaa

SEQ ID NO: 12717 - RNA, 20 nt, Artificial Sequence
  Guide Sequence
acagcuaccuaacuacccac

SEQ ID NO: 12718 - RNA, 20 nt, Artificial Sequence
  Guide Sequence
acaggugggcaccccgauuu

SEQ ID NO: 12719 - RNA, 20 nt, Artificial Sequence
  Guide Sequence
acaguggcucacaccuuuaa

SEQ ID NO: 12720 - RNA, 20 nt, Artificial Sequence
  Guide Sequence
acaguggcucacacuuguaa

SEQ ID NO: 12721 - RNA, 20 nt, Artificial Sequence
  Guide Sequence
accacaggugggcaccccga

SEQ ID NO: 12722 - RNA, 20 nt, Artificial Sequence
  Guide Sequence
accagaccaggcacaguggc

SEQ ID NO: 12723 - RNA, 20 nt, Artificial Sequence
  Guide Sequence
accaggcacaguggcucaca

SEQ ID NO: 12724 - RNA, 20 nt, Artificial Sequence
  Guide Sequence
acccaaaccagaccaggcac

SEQ ID NO: 12725 - RNA, 20 nt, Artificial Sequence
  Guide Sequence
acccaagggaagggaggaag

SEQ ID NO: 12726 - RNA, 20 nt, Artificial Sequence
  Guide Sequence
acccaccacaggugggcacc

SEQ ID NO: 12727 - RNA, 20 nt, Artificial Sequence
  Guide Sequence
acccagaaggcggagauugc

SEQ ID NO: 12728 - RNA, 20 nt, Artificial Sequence
  Guide Sequence
accccgauuugugguuucaa

SEQ ID NO: 12729 - RNA, 20 nt, Artificial Sequence
  Guide Sequence
acccugggcccccucaccca

SEQ ID NO: 12730 - RNA, 20 nt, Artificial Sequence
  Guide Sequence
accuaacuacccaccacagg

SEQ ID NO: 12731 - RNA, 20 nt, Artificial Sequence
  Guide Sequence
accuuuaaucccagcacucu

SEQ ID NO: 12732 - RNA, 20 nt, Artificial Sequence
  Guide Sequence
acuacccaccacaggugggc

SEQ ID NO: 12733 - RNA, 20 nt, Artificial Sequence
  Guide Sequence
acucaaaaaagagacccaga

SEQ ID NO: 12734 - RNA, 20 nt, Artificial Sequence
  Guide Sequence
acuccagccugggcgacaga

SEQ ID NO: 12735 - RNA, 20 nt, Artificial Sequence
  Guide Sequence
acucuggaaggccgaggcag

SEQ ID NO: 12736 - RNA, 20 nt, Artificial Sequence
  Guide Sequence
acugcacuccagccugggcg

SEQ ID NO: 12737 - RNA, 20 nt, Artificial Sequence
  Guide Sequence
acuguggguauucccccauu

SEQ ID NO: 12738 - RNA, 20 nt, Artificial Sequence
  Guide Sequence
acuuguaaucccagcacuuu

SEQ ID NO: 12739 - RNA, 20 nt, Artificial Sequence
  Guide Sequence
acuuugggaggcugaggcag

SEQ ID NO: 12740 - RNA, 20 nt, Artificial Sequence
  Guide Sequence
acuuuguaacagcuaccuaa

SEQ ID NO: 12741 - RNA, 20 nt, Artificial Sequence
  Guide Sequence
agaacaaucaagagacccaa

SEQ ID NO: 12742 - RNA, 20 nt, Artificial Sequence
  Guide Sequence
agaaggcggagauugcagug

SEQ ID NO: 12743 - RNA, 20 nt, Artificial Sequence
  Guide Sequence
agaauaaaaguuagucaagg

SEQ ID NO: 12744 - RNA, 20 nt, Artificial Sequence
  Guide Sequence
agaaucauuugaacccagaa

SEQ ID NO: 12745 - RNA, 20 nt, Artificial Sequence
  Guide Sequence
agaccaggcacaguggcuca

SEQ ID NO: 12746 - RNA, 20 nt, Artificial Sequence
  Guide Sequence
agacccaaaccagaccaggc

SEQ ID NO: 12747 - RNA, 20 nt, Artificial Sequence
  Guide Sequence
agacucaaaaaagagaccca

SEQ ID NO: 12748 - RNA, 20 nt, Artificial Sequence
  Guide Sequence
agagacccaaaccagaccag

SEQ ID NO: 12749 - RNA, 20 nt, Artificial Sequence
  Guide Sequence
agagacucaaaaaagagacc

SEQ ID NO: 12750 - RNA, 20 nt, Artificial Sequence
  Guide Sequence
agagcaagagacucaaaaaa

SEQ ID NO: 12751 - RNA, 20 nt, Artificial Sequence
  Guide Sequence
agauggcgccacugcacucc

SEQ ID NO: 12752 - RNA, 20 nt, Artificial Sequence
  Guide Sequence
agauugcagugagcugagau

SEQ ID NO: 12753 - RNA, 20 nt, Artificial Sequence
  Guide Sequence
agcaagagacucaaaaaaga

SEQ ID NO: 12754 - RNA, 20 nt, Artificial Sequence
  Guide Sequence
agcacucuggaaggccgagg

SEQ ID NO: 12755 - RNA, 20 nt, Artificial Sequence
  Guide Sequence
agcacuuugggaggcugagg

SEQ ID NO: 12756 - RNA, 20 nt, Artificial Sequence
  Guide Sequence
agccugggcgacagagcaag

SEQ ID NO: 12757 - RNA, 20 nt, Artificial Sequence
  Guide Sequence
agcgccucuuccucaugccc

SEQ ID NO: 12758 - RNA, 20 nt, Artificial Sequence
  Guide Sequence
agcuaccuaacuacccacca

SEQ ID NO: 12759 - RNA, 20 nt, Artificial Sequence
  Guide Sequence
agcugagauggcgccacugc

SEQ ID NO: 12760 - RNA, 20 nt, Artificial Sequence
  Guide Sequence
aggaagcgccucuuccucau

SEQ ID NO: 12761 - RNA, 20 nt, Artificial Sequence
  Guide Sequence
aggagaaucauuugaaccca

SEQ ID NO: 12762 - RNA, 20 nt, Artificial Sequence
  Guide Sequence
aggcacaguggcucacaccu

SEQ ID NO: 12763 - RNA, 20 nt, Artificial Sequence
  Guide Sequence
aggcacaguggcucacacuu

SEQ ID NO: 12764 - RNA, 20 nt, Artificial Sequence
  Guide Sequence
aggcaggagaaucauuugaa

SEQ ID NO: 12765 - RNA, 20 nt, Artificial Sequence
  Guide Sequence
aggcggagauugcagugagc

SEQ ID NO: 12766 - RNA, 20 nt, Artificial Sequence
  Guide Sequence
aggcugaggcaggagaauca

SEQ ID NO: 12767 - RNA, 20 nt, Artificial Sequence
  Guide Sequence
agggaagggaggaagcgccu

SEQ ID NO: 12768 - RNA, 20 nt, Artificial Sequence
  Guide Sequence
agggaggaagcgccucuucc

SEQ ID NO: 12769 - RNA, 20 nt, Artificial Sequence
  Guide Sequence
agggaguggccaggcacagu

SEQ ID NO: 12770 - RNA, 20 nt, Artificial Sequence
  Guide Sequence
agggggucucugcuggggca

SEQ ID NO: 12771 - RNA, 20 nt, Artificial Sequence
  Guide Sequence
aggugggcaccccgauuugu

SEQ ID NO: 12772 - RNA, 20 nt, Artificial Sequence
  Guide Sequence
agucaagggggucucugcug

SEQ ID NO: 12773 - RNA, 20 nt, Artificial Sequence
  Guide Sequence
agucucaagggaguggccag

SEQ ID NO: 12774 - RNA, 20 nt, Artificial Sequence
  Guide Sequence
agugagcugagauggcgcca

SEQ ID NO: 12775 - RNA, 20 nt, Artificial Sequence
  Guide Sequence
aguggccaggcacaguggcu

SEQ ID NO: 12776 - RNA, 20 nt, Artificial Sequence
  Guide Sequence
aguggcucacaccuuuaauc

SEQ ID NO: 12777 - RNA, 20 nt, Artificial Sequence
  Guide Sequence
aguggcucacacuuguaauc

SEQ ID NO: 12778 - RNA, 20 nt, Artificial Sequence
  Guide Sequence
aguuagucaagggggucucu

SEQ ID NO: 12779 - RNA, 20 nt, Artificial Sequence
  Guide Sequence
auaaaaguuagucaaggggg

SEQ ID NO: 12780 - RNA, 20 nt, Artificial Sequence
  Guide Sequence
aucaagagacccaaaccaga

SEQ ID NO: 12781 - RNA, 20 nt, Artificial Sequence
  Guide Sequence
aucacccugggcccccucac

SEQ ID NO: 12782 - RNA, 20 nt, Artificial Sequence
  Guide Sequence
aucauuugaacccagaaggc

SEQ ID NO: 12783 - RNA, 20 nt, Artificial Sequence
  Guide Sequence
aucccagcacucuggaaggc

SEQ ID NO: 12784 - RNA, 20 nt, Artificial Sequence
  Guide Sequence
aucccagcacuuugggaggc

SEQ ID NO: 12785 - RNA, 20 nt, Artificial Sequence
  Guide Sequence
aucuaauucucacugugggu

SEQ ID NO: 12786 - RNA, 20 nt, Artificial Sequence
  Guide Sequence
aucuaucucaucuaauucuc

SEQ ID NO: 12787 - RNA, 20 nt, Artificial Sequence
  Guide Sequence
aucucaucuaauucucacug

SEQ ID NO: 12788 - RNA, 20 nt, Artificial Sequence
  Guide Sequence
augcaucuaucucaucuaau

SEQ ID NO: 12789 - RNA, 20 nt, Artificial Sequence
  Guide Sequence
augccccugaagaacaauca

SEQ ID NO: 12790 - RNA, 20 nt, Artificial Sequence
  Guide Sequence
auggcgccacugcacuccag

SEQ ID NO: 12791 - RNA, 20 nt, Artificial Sequence
  Guide Sequence
auucccccauuucacagacg

SEQ ID NO: 12792 - RNA, 20 nt, Artificial Sequence
  Guide Sequence
auucucacuguggguauucc

SEQ ID NO: 12793 - RNA, 20 nt, Artificial Sequence
  Guide Sequence
auugcagugagcugagaugg

SEQ ID NO: 12794 - RNA, 20 nt, Artificial Sequence
  Guide Sequence
auuugaacccagaaggcgga

SEQ ID NO: 12795 - RNA, 20 nt, Artificial Sequence
  Guide Sequence
auuugugguuucaaaugcau

SEQ ID NO: 12796 - RNA, 20 nt, Artificial Sequence
  Guide Sequence
caaaccagaccaggcacagu

SEQ ID NO: 12797 - RNA, 20 nt, Artificial Sequence
  Guide Sequence
caaaugcaucuaucucaucu

SEQ ID NO: 12798 - RNA, 20 nt, Artificial Sequence
  Guide Sequence
caagagacccaaaccagacc

SEQ ID NO: 12799 - RNA, 20 nt, Artificial Sequence
  Guide Sequence
caagagacucaaaaaagaga

SEQ ID NO: 12800 - RNA, 20 nt, Artificial Sequence
  Guide Sequence
caagggaagggaggaagcgc

SEQ ID NO: 12801 - RNA, 20 nt, Artificial Sequence
  Guide Sequence
caagggaguggccaggcaca

SEQ ID NO: 12802 - RNA, 20 nt, Artificial Sequence
  Guide Sequence
caagggggucucugcugggg

SEQ ID NO: 12803 - RNA, 20 nt, Artificial Sequence
  Guide Sequence
caaucaagagacccaaacca

SEQ ID NO: 12804 - RNA, 20 nt, Artificial Sequence
  Guide Sequence
cacaccuuuaaucccagcac

SEQ ID NO: 12805 - RNA, 20 nt, Artificial Sequence
  Guide Sequence
cacacuuguaaucccagcac

SEQ ID NO: 12806 - RNA, 20 nt, Artificial Sequence
  Guide Sequence
cacaggugggcaccccgauu

SEQ ID NO: 12807 - RNA, 20 nt, Artificial Sequence
  Guide Sequence
cacaguggcucacaccuuua

SEQ ID NO: 12808 - RNA, 20 nt, Artificial Sequence
  Guide Sequence
cacaguggcucacacuugua

SEQ ID NO: 12809 - RNA, 20 nt, Artificial Sequence
  Guide Sequence
caccacaggugggcaccccg

SEQ ID NO: 12810 - RNA, 20 nt, Artificial Sequence
  Guide Sequence
cacccaagggaagggaggaa

SEQ ID NO: 12811 - RNA, 20 nt, Artificial Sequence
  Guide Sequence
caccccgauuugugguuuca

SEQ ID NO: 12812 - RNA, 20 nt, Artificial Sequence
  Guide Sequence
cacccugggcccccucaccc

SEQ ID NO: 12813 - RNA, 20 nt, Artificial Sequence
  Guide Sequence
caccuuuaaucccagcacuc

SEQ ID NO: 12814 - RNA, 20 nt, Artificial Sequence
  Guide Sequence
cacuccagccugggcgacag

SEQ ID NO: 12815 - RNA, 20 nt, Artificial Sequence
  Guide Sequence
cacucuggaaggccgaggca

SEQ ID NO: 12816 - RNA, 20 nt, Artificial Sequence
  Guide Sequence
cacugcacuccagccugggc

SEQ ID NO: 12817 - RNA, 20 nt, Artificial Sequence
  Guide Sequence
cacuguggguauucccccau

SEQ ID NO: 12818 - RNA, 20 nt, Artificial Sequence
  Guide Sequence
cacuuguaaucccagcacuu

SEQ ID NO: 12819 - RNA, 20 nt, Artificial Sequence
  Guide Sequence
cacuuugggaggcugaggca

SEQ ID NO: 12820 - RNA, 20 nt, Artificial Sequence
  Guide Sequence
cacuuuguaacagcuaccua

SEQ ID NO: 12821 - RNA, 20 nt, Artificial Sequence
  Guide Sequence
cagaaggcggagauugcagu

SEQ ID NO: 12822 - RNA, 20 nt, Artificial Sequence
  Guide Sequence
cagaccaggcacaguggcuc

SEQ ID NO: 12823 - RNA, 20 nt, Artificial Sequence
  Guide Sequence
cagagcaagagacucaaaaa

SEQ ID NO: 12824 - RNA, 20 nt, Artificial Sequence
  Guide Sequence
cagcacucuggaaggccgag

SEQ ID NO: 12825 - RNA, 20 nt, Artificial Sequence
  Guide Sequence
cagcacuuugggaggcugag

SEQ ID NO: 12826 - RNA, 20 nt, Artificial Sequence
  Guide Sequence
cagccugggcgacagagcaa

SEQ ID NO: 12827 - RNA, 20 nt, Artificial Sequence
  Guide Sequence
cagcuaccuaacuacccacc

SEQ ID NO: 12828 - RNA, 20 nt, Artificial Sequence
  Guide Sequence
caggagaaucauuugaaccc

SEQ ID NO: 12829 - RNA, 20 nt, Artificial Sequence
  Guide Sequence
caggcacaguggcucacacc

SEQ ID NO: 12830 - RNA, 20 nt, Artificial Sequence
  Guide Sequence
caggcacaguggcucacacu

SEQ ID NO: 12831 - RNA, 20 nt, Artificial Sequence
  Guide Sequence
caggugggcaccccgauuug

SEQ ID NO: 12832 - RNA, 20 nt, Artificial Sequence
  Guide Sequence
cagugagcugagauggcgcc

SEQ ID NO: 12833 - RNA, 20 nt, Artificial Sequence
  Guide Sequence
caguggcucacaccuuuaau

SEQ ID NO: 12834 - RNA, 20 nt, Artificial Sequence
  Guide Sequence
caguggcucacacuuguaau

SEQ ID NO: 12835 - RNA, 20 nt, Artificial Sequence
  Guide Sequence
caucuaauucucacuguggg

SEQ ID NO: 12836 - RNA, 20 nt, Artificial Sequence
  Guide Sequence
caucuaucucaucuaauucu

SEQ ID NO: 12837 - RNA, 20 nt, Artificial Sequence
  Guide Sequence
caugccccugaagaacaauc

SEQ ID NO: 12838 - RNA, 20 nt, Artificial Sequence
  Guide Sequence
cauuugaacccagaaggcgg

SEQ ID NO: 12839 - RNA, 20 nt, Artificial Sequence
  Guide Sequence
ccaaaccagaccaggcacag

SEQ ID NO: 12840 - RNA, 20 nt, Artificial Sequence
  Guide Sequence
ccaagggaagggaggaagcg

SEQ ID NO: 12841 - RNA, 20 nt, Artificial Sequence
  Guide Sequence
ccacaggugggcaccccgau

SEQ ID NO: 12842 - RNA, 20 nt, Artificial Sequence
  Guide Sequence
ccaccacaggugggcacccc

SEQ ID NO: 12843 - RNA, 20 nt, Artificial Sequence
  Guide Sequence
ccacugcacuccagccuggg

SEQ ID NO: 12844 - RNA, 20 nt, Artificial Sequence
  Guide Sequence
ccagaaggcggagauugcag

SEQ ID NO: 12845 - RNA, 20 nt, Artificial Sequence
  Guide Sequence
ccagaccaggcacaguggcu

SEQ ID NO: 12846 - RNA, 20 nt, Artificial Sequence
  Guide Sequence
ccagcacucuggaaggccga

SEQ ID NO: 12847 - RNA, 20 nt, Artificial Sequence
  Guide Sequence
ccagcacuuugggaggcuga

SEQ ID NO: 12848 - RNA, 20 nt, Artificial Sequence
  Guide Sequence
ccagccugggcgacagagca

SEQ ID NO: 12849 - RNA, 20 nt, Artificial Sequence
  Guide Sequence
ccaggcacaguggcucacac

SEQ ID NO: 12850 - RNA, 20 nt, Artificial Sequence
  Guide Sequence
cccaaaccagaccaggcaca

SEQ ID NO: 12851 - RNA, 20 nt, Artificial Sequence
  Guide Sequence
cccaagggaagggaggaagc

SEQ ID NO: 12852 - RNA, 20 nt, Artificial Sequence
  Guide Sequence
cccaccacaggugggcaccc

SEQ ID NO: 12853 - RNA, 20 nt, Artificial Sequence
  Guide Sequence
cccagaaggcggagauugca

SEQ ID NO: 12854 - RNA, 20 nt, Artificial Sequence
  Guide Sequence
cccagcacucuggaaggccg

SEQ ID NO: 12855 - RNA, 20 nt, Artificial Sequence
  Guide Sequence
cccagcacuuugggaggcug

SEQ ID NO: 12856 - RNA, 20 nt, Artificial Sequence
  Guide Sequence
cccauuucacagacguggaa

SEQ ID NO: 12857 - RNA, 20 nt, Artificial Sequence
  Guide Sequence
ccccauuucacagacgugga

SEQ ID NO: 12858 - RNA, 20 nt, Artificial Sequence
  Guide Sequence
cccccauuucacagacgugg

SEQ ID NO: 12859 - RNA, 20 nt, Artificial Sequence
  Guide Sequence
cccccucacccaagggaagg

SEQ ID NO: 12860 - RNA, 20 nt, Artificial Sequence
  Guide Sequence
ccccgauuugugguuucaaa

SEQ ID NO: 12861 - RNA, 20 nt, Artificial Sequence
  Guide Sequence
ccccucacccaagggaaggg

SEQ ID NO: 12862 - RNA, 20 nt, Artificial Sequence
  Guide Sequence
ccccugaagaacaaucaaga

SEQ ID NO: 12863 - RNA, 20 nt, Artificial Sequence
  Guide Sequence
cccgauuugugguuucaaau

SEQ ID NO: 12864 - RNA, 20 nt, Artificial Sequence
  Guide Sequence
cccucacccaagggaaggga

SEQ ID NO: 12865 - RNA, 20 nt, Artificial Sequence
  Guide Sequence
cccugaagaacaaucaagag

SEQ ID NO: 12866 - RNA, 20 nt, Artificial Sequence
  Guide Sequence
cccugggcccccucacccaa

SEQ ID NO: 12867 - RNA, 20 nt, Artificial Sequence
  Guide Sequence
ccgauuugugguuucaaaug

SEQ ID NO: 12868 - RNA, 20 nt, Artificial Sequence
  Guide Sequence
ccuaacuacccaccacaggu

SEQ ID NO: 12869 - RNA, 20 nt, Artificial Sequence
  Guide Sequence
ccucacccaagggaagggag

SEQ ID NO: 12870 - RNA, 20 nt, Artificial Sequence
  Guide Sequence
ccucaugccccugaagaaca

SEQ ID NO: 12871 - RNA, 20 nt, Artificial Sequence
  Guide Sequence
ccucuuccucaugccccuga

SEQ ID NO: 12872 - RNA, 20 nt, Artificial Sequence
  Guide Sequence
ccugaagaacaaucaagaga

SEQ ID NO: 12873 - RNA, 20 nt, Artificial Sequence
  Guide Sequence
ccugggcccccucacccaag

SEQ ID NO: 12874 - RNA, 20 nt, Artificial Sequence
  Guide Sequence
ccugggcgacagagcaagag

SEQ ID NO: 12875 - RNA, 20 nt, Artificial Sequence
  Guide Sequence
ccuuuaaucccagcacucug

SEQ ID NO: 12876 - RNA, 20 nt, Artificial Sequence
  Guide Sequence
cgacagagcaagagacucaa

SEQ ID NO: 12877 - RNA, 20 nt, Artificial Sequence
  Guide Sequence
cgauuugugguuucaaaugc

SEQ ID NO: 12878 - RNA, 20 nt, Artificial Sequence
  Guide Sequence
cgccacugcacuccagccug

SEQ ID NO: 12879 - RNA, 20 nt, Artificial Sequence
  Guide Sequence
cgccucuuccucaugccccu

SEQ ID NO: 12880 - RNA, 20 nt, Artificial Sequence
  Guide Sequence
cggagauugcagugagcuga

SEQ ID NO: 12881 - RNA, 20 nt, Artificial Sequence
  Guide Sequence
cuaacuacccaccacaggug

SEQ ID NO: 12882 - RNA, 20 nt, Artificial Sequence
  Guide Sequence
cuaauucucacuguggguau

SEQ ID NO: 12883 - RNA, 20 nt, Artificial Sequence
  Guide Sequence
cuacccaccacaggugggca

SEQ ID NO: 12884 - RNA, 20 nt, Artificial Sequence
  Guide Sequence
cuaccuaacuacccaccaca

SEQ ID NO: 12885 - RNA, 20 nt, Artificial Sequence
  Guide Sequence
cuaucucaucuaauucucac

SEQ ID NO: 12886 - RNA, 20 nt, Artificial Sequence
  Guide Sequence
cucaaaaaagagacccagac

SEQ ID NO: 12887 - RNA, 20 nt, Artificial Sequence
  Guide Sequence
cucaagggaguggccaggca

SEQ ID NO: 12888 - RNA, 20 nt, Artificial Sequence
  Guide Sequence
cucacaccuuuaaucccagc

SEQ ID NO: 12889 - RNA, 20 nt, Artificial Sequence
  Guide Sequence
cucacacuuguaaucccagc

SEQ ID NO: 12890 - RNA, 20 nt, Artificial Sequence
  Guide Sequence
cucacccaagggaagggagg

SEQ ID NO: 12891 - RNA, 20 nt, Artificial Sequence
  Guide Sequence
cucacuguggguauuccccc

SEQ ID NO: 12892 - RNA, 20 nt, Artificial Sequence
  Guide Sequence
cucaucuaauucucacugug

SEQ ID NO: 12893 - RNA, 20 nt, Artificial Sequence
  Guide Sequence
cucaugccccugaagaacaa

SEQ ID NO: 12894 - RNA, 20 nt, Artificial Sequence
  Guide Sequence
cuccagccugggcgacagag

SEQ ID NO: 12895 - RNA, 20 nt, Artificial Sequence
  Guide Sequence
cucugcuggggcacuuugua

SEQ ID NO: 12896 - RNA, 20 nt, Artificial Sequence
  Guide Sequence
cucuggaaggccgaggcagg

SEQ ID NO: 12897 - RNA, 20 nt, Artificial Sequence
  Guide Sequence
cucuuccucaugccccugaa

SEQ ID NO: 12898 - RNA, 20 nt, Artificial Sequence
  Guide Sequence
cugaagaacaaucaagagac

SEQ ID NO: 12899 - RNA, 20 nt, Artificial Sequence
  Guide Sequence
cugagauggcgccacugcac

SEQ ID NO: 12900 - RNA, 20 nt, Artificial Sequence
  Guide Sequence
cugaggcaggagaaucauuu

SEQ ID NO: 12901 - RNA, 20 nt, Artificial Sequence
  Guide Sequence
cugcacuccagccugggcga

SEQ ID NO: 12902 - RNA, 20 nt, Artificial Sequence
  Guide Sequence
cugcuggggcacuuuguaac

SEQ ID NO: 12903 - RNA, 20 nt, Artificial Sequence
  Guide Sequence
cuggaaggccgaggcaggug

SEQ ID NO: 12904 - RNA, 20 nt, Artificial Sequence
  Guide Sequence
cugggcccccucacccaagg

SEQ ID NO: 12905 - RNA, 20 nt, Artificial Sequence
  Guide Sequence
cugggcgacagagcaagaga

SEQ ID NO: 12906 - RNA, 20 nt, Artificial Sequence
  Guide Sequence
cuggggcacuuuguaacagc

SEQ ID NO: 12907 - RNA, 20 nt, Artificial Sequence
  Guide Sequence
cugugggaaaagauggaaga

SEQ ID NO: 12908 - RNA, 20 nt, Artificial Sequence
  Guide Sequence
cuguggguauucccccauuu

SEQ ID NO: 12909 - RNA, 20 nt, Artificial Sequence
  Guide Sequence
cuuccucaugccccugaaga

SEQ ID NO: 12910 - RNA, 20 nt, Artificial Sequence
  Guide Sequence
cuuguaaucccagcacuuug

SEQ ID NO: 12911 - RNA, 20 nt, Artificial Sequence
  Guide Sequence
cuuuaaucccagcacucugg

SEQ ID NO: 12912 - RNA, 20 nt, Artificial Sequence
  Guide Sequence
cuuugggaggcugaggcagg

SEQ ID NO: 12913 - RNA, 20 nt, Artificial Sequence
  Guide Sequence
cuuuguaacagcuaccuaac

SEQ ID NO: 12914 - RNA, 20 nt, Artificial Sequence
  Guide Sequence
gaacaaucaagagacccaaa

SEQ ID NO: 12915 - RNA, 20 nt, Artificial Sequence
  Guide Sequence
gaacccagaaggcggagauu

SEQ ID NO: 12916 - RNA, 20 nt, Artificial Sequence
  Guide Sequence
gaagaacaaucaagagaccc

SEQ ID NO: 12917 - RNA, 20 nt, Artificial Sequence
  Guide Sequence
gaagcgccucuuccucaugc

SEQ ID NO: 12918 - RNA, 20 nt, Artificial Sequence
  Guide Sequence
gaaggcggagauugcaguga

SEQ ID NO: 12919 - RNA, 20 nt, Artificial Sequence
  Guide Sequence
gaagggaggaagcgccucuu

SEQ ID NO: 12920 - RNA, 20 nt, Artificial Sequence
  Guide Sequence
gaauaaaaguuagucaaggg

SEQ ID NO: 12921 - RNA, 20 nt, Artificial Sequence
  Guide Sequence
gaaucauuugaacccagaag

SEQ ID NO: 12922 - RNA, 20 nt, Artificial Sequence
  Guide Sequence
gacagagcaagagacucaaa

SEQ ID NO: 12923 - RNA, 20 nt, Artificial Sequence
  Guide Sequence
gaccaggcacaguggcucac

SEQ ID NO: 12924 - RNA, 20 nt, Artificial Sequence
  Guide Sequence
gacccaaaccagaccaggca

SEQ ID NO: 12925 - RNA, 20 nt, Artificial Sequence
  Guide Sequence
gacucaaaaaagagacccag

SEQ ID NO: 12926 - RNA, 20 nt, Artificial Sequence
  Guide Sequence
gagaaucauuugaacccaga

SEQ ID NO: 12927 - RNA, 20 nt, Artificial Sequence
  Guide Sequence
gagacccaaaccagaccagg

SEQ ID NO: 12928 - RNA, 20 nt, Artificial Sequence
  Guide Sequence
gagacucaaaaaagagaccc

SEQ ID NO: 12929 - RNA, 20 nt, Artificial Sequence
  Guide Sequence
gagauggcgccacugcacuc

SEQ ID NO: 12930 - RNA, 20 nt, Artificial Sequence
  Guide Sequence
gagauugcagugagcugaga

SEQ ID NO: 12931 - RNA, 20 nt, Artificial Sequence
  Guide Sequence
gagcaagagacucaaaaaag

SEQ ID NO: 12932 - RNA, 20 nt, Artificial Sequence
  Guide Sequence
gagcugagauggcgccacug

SEQ ID NO: 12933 - RNA, 20 nt, Artificial Sequence
  Guide Sequence
gaggaagcgccucuuccuca

SEQ ID NO: 12934 - RNA, 20 nt, Artificial Sequence
  Guide Sequence
gaggcaggagaaucauuuga

SEQ ID NO: 12935 - RNA, 20 nt, Artificial Sequence
  Guide Sequence
gaggcugaggcaggagaauc

SEQ ID NO: 12936 - RNA, 20 nt, Artificial Sequence
  Guide Sequence
gaguggccaggcacaguggc

SEQ ID NO: 12937 - RNA, 20 nt, Artificial Sequence
  Guide Sequence
gauggaagaauaaaaguuag

SEQ ID NO: 12938 - RNA, 20 nt, Artificial Sequence
  Guide Sequence
gauggcgccacugcacucca

SEQ ID NO: 12939 - RNA, 20 nt, Artificial Sequence
  Guide Sequence
gauugcagugagcugagaug

SEQ ID NO: 12940 - RNA, 20 nt, Artificial Sequence
  Guide Sequence
gauuugugguuucaaaugca

SEQ ID NO: 12941 - RNA, 20 nt, Artificial Sequence
  Guide Sequence
gcaagagacucaaaaaagag

SEQ ID NO: 12942 - RNA, 20 nt, Artificial Sequence
  Guide Sequence
gcacaguggcucacaccuuu

SEQ ID NO: 12943 - RNA, 20 nt, Artificial Sequence
  Guide Sequence
gcacaguggcucacacuugu

SEQ ID NO: 12944 - RNA, 20 nt, Artificial Sequence
  Guide Sequence
gcaccccgauuugugguuuc

SEQ ID NO: 12945 - RNA, 20 nt, Artificial Sequence
  Guide Sequence
gcacuccagccugggcgaca

SEQ ID NO: 12946 - RNA, 20 nt, Artificial Sequence
  Guide Sequence
gcacucuggaaggccgaggc

SEQ ID NO: 12947 - RNA, 20 nt, Artificial Sequence
  Guide Sequence
gcacuuugggaggcugaggc

SEQ ID NO: 12948 - RNA, 20 nt, Artificial Sequence
  Guide Sequence
gcacuuuguaacagcuaccu

SEQ ID NO: 12949 - RNA, 20 nt, Artificial Sequence
  Guide Sequence
gcaggagaaucauuugaacc

SEQ ID NO: 12950 - RNA, 20 nt, Artificial Sequence
  Guide Sequence
gcagugagcugagauggcgc

SEQ ID NO: 12951 - RNA, 20 nt, Artificial Sequence
  Guide Sequence
gcaucuaucucaucuaauuc

SEQ ID NO: 12952 - RNA, 20 nt, Artificial Sequence
  Guide Sequence
gccacugcacuccagccugg

SEQ ID NO: 12953 - RNA, 20 nt, Artificial Sequence
  Guide Sequence
gccaggcacaguggcucaca

SEQ ID NO: 12954 - RNA, 20 nt, Artificial Sequence
  Guide Sequence
gcccccucacccaagggaag

SEQ ID NO: 12955 - RNA, 20 nt, Artificial Sequence
  Guide Sequence
gccccugaagaacaaucaag

SEQ ID NO: 12956 - RNA, 20 nt, Artificial Sequence
  Guide Sequence
gccucuuccucaugccccug

SEQ ID NO: 12957 - RNA, 20 nt, Artificial Sequence
  Guide Sequence
gccugggcgacagagcaaga

SEQ ID NO: 12958 - RNA, 20 nt, Artificial Sequence
  Guide Sequence
gcgacagagcaagagacuca

SEQ ID NO: 12959 - RNA, 20 nt, Artificial Sequence
  Guide Sequence
gcgccacugcacuccagccu

SEQ ID NO: 12960 - RNA, 20 nt, Artificial Sequence
  Guide Sequence
gcgccucuuccucaugcccc

SEQ ID NO: 12961 - RNA, 20 nt, Artificial Sequence
  Guide Sequence
gcggagauugcagugagcug

SEQ ID NO: 12962 - RNA, 20 nt, Artificial Sequence
  Guide Sequence
gcuaccuaacuacccaccac

SEQ ID NO: 12963 - RNA, 20 nt, Artificial Sequence
  Guide Sequence
gcucacaccuuuaaucccag

SEQ ID NO: 12964 - RNA, 20 nt, Artificial Sequence
  Guide Sequence
gcucacacuuguaaucccag

SEQ ID NO: 12965 - RNA, 20 nt, Artificial Sequence
  Guide Sequence
gcugagauggcgccacugca

SEQ ID NO: 12966 - RNA, 20 nt, Artificial Sequence
  Guide Sequence
gcugaggcaggagaaucauu

SEQ ID NO: 12967 - RNA, 20 nt, Artificial Sequence
  Guide Sequence
gcuggggcacuuuguaacag

SEQ ID NO: 12968 - RNA, 20 nt, Artificial Sequence
  Guide Sequence
ggaaaagauggaagaauaaa

SEQ ID NO: 12969 - RNA, 20 nt, Artificial Sequence
  Guide Sequence
ggaagaauaaaaguuaguca

SEQ ID NO: 12970 - RNA, 20 nt, Artificial Sequence
  Guide Sequence
ggaagcgccucuuccucaug

SEQ ID NO: 12971 - RNA, 20 nt, Artificial Sequence
  Guide Sequence
ggaagggaggaagcgccucu

SEQ ID NO: 12972 - RNA, 20 nt, Artificial Sequence
  Guide Sequence
ggagaaucauuugaacccag

SEQ ID NO: 12973 - RNA, 20 nt, Artificial Sequence
  Guide Sequence
ggagauugcagugagcugag

SEQ ID NO: 12974 - RNA, 20 nt, Artificial Sequence
  Guide Sequence
ggaggaagcgccucuuccuc

SEQ ID NO: 12975 - RNA, 20 nt, Artificial Sequence
  Guide Sequence
ggaggcugaggcaggagaau

SEQ ID NO: 12976 - RNA, 20 nt, Artificial Sequence
  Guide Sequence
ggaguggccaggcacagugg

SEQ ID NO: 12977 - RNA, 20 nt, Artificial Sequence
  Guide Sequence
ggcacaguggcucacaccuu

SEQ ID NO: 12978 - RNA, 20 nt, Artificial Sequence
  Guide Sequence
ggcacaguggcucacacuug

SEQ ID NO: 12979 - RNA, 20 nt, Artificial Sequence
  Guide Sequence
ggcaccccgauuugugguuu

SEQ ID NO: 12980 - RNA, 20 nt, Artificial Sequence
  Guide Sequence
ggcacuuuguaacagcuacc

SEQ ID NO: 12981 - RNA, 20 nt, Artificial Sequence
  Guide Sequence
ggcaggagaaucauuugaac

SEQ ID NO: 12982 - RNA, 20 nt, Artificial Sequence
  Guide Sequence
ggccaggcacaguggcucac

SEQ ID NO: 12983 - RNA, 20 nt, Artificial Sequence
  Guide Sequence
ggcccccucacccaagggaa

SEQ ID NO: 12984 - RNA, 20 nt, Artificial Sequence
  Guide Sequence
ggcgacagagcaagagacuc

SEQ ID NO: 12985 - RNA, 20 nt, Artificial Sequence
  Guide Sequence
ggcgccacugcacuccagcc

SEQ ID NO: 12986 - RNA, 20 nt, Artificial Sequence
  Guide Sequence
ggcggagauugcagugagcu

SEQ ID NO: 12987 - RNA, 20 nt, Artificial Sequence
  Guide Sequence
ggcucacaccuuuaauccca

SEQ ID NO: 12988 - RNA, 20 nt, Artificial Sequence
  Guide Sequence
ggcucacacuuguaauccca

SEQ ID NO: 12989 - RNA, 20 nt, Artificial Sequence
  Guide Sequence
ggcugaggcaggagaaucau

SEQ ID NO: 12990 - RNA, 20 nt, Artificial Sequence
  Guide Sequence
gggaaaagauggaagaauaa

SEQ ID NO: 12991 - RNA, 20 nt, Artificial Sequence
  Guide Sequence
gggaagggaggaagcgccuc

SEQ ID NO: 12992 - RNA, 20 nt, Artificial Sequence
  Guide Sequence
gggaggaagcgccucuuccu

SEQ ID NO: 12993 - RNA, 20 nt, Artificial Sequence
  Guide Sequence
gggaggcugaggcaggagaa

SEQ ID NO: 12994 - RNA, 20 nt, Artificial Sequence
  Guide Sequence
gggaguggccaggcacagug

SEQ ID NO: 12995 - RNA, 20 nt, Artificial Sequence
  Guide Sequence
gggcaccccgauuugugguu

SEQ ID NO: 12996 - RNA, 20 nt, Artificial Sequence
  Guide Sequence
gggcacuuuguaacagcuac

SEQ ID NO: 12997 - RNA, 20 nt, Artificial Sequence
  Guide Sequence
gggcccccucacccaaggga

SEQ ID NO: 12998 - RNA, 20 nt, Artificial Sequence
  Guide Sequence
gggcgacagagcaagagacu

SEQ ID NO: 12999 - RNA, 20 nt, Artificial Sequence
  Guide Sequence
ggggcacuuuguaacagcua

SEQ ID NO: 13000 - RNA, 20 nt, Artificial Sequence
  Guide Sequence
gggggucucugcuggggcac

SEQ ID NO: 13001 - RNA, 20 nt, Artificial Sequence
  Guide Sequence
ggggucucugcuggggcacu

SEQ ID NO: 13002 - RNA, 20 nt, Artificial Sequence
  Guide Sequence
ggguauucccccauuucaca

SEQ ID NO: 13003 - RNA, 20 nt, Artificial Sequence
  Guide Sequence
gggucucugcuggggcacuu

SEQ ID NO: 13004 - RNA, 20 nt, Artificial Sequence
  Guide Sequence
gguauucccccauuucacag

SEQ ID NO: 13005 - RNA, 20 nt, Artificial Sequence
  Guide Sequence
ggucucugcuggggcacuuu

SEQ ID NO: 13006 - RNA, 20 nt, Artificial Sequence
  Guide Sequence
ggugggcaccccgauuugug

SEQ ID NO: 13007 - RNA, 20 nt, Artificial Sequence
  Guide Sequence
gguuucaaaugcaucuaucu

SEQ ID NO: 13008 - RNA, 20 nt, Artificial Sequence
  Guide Sequence
guaacagcuaccuaacuacc

SEQ ID NO: 13009 - RNA, 20 nt, Artificial Sequence
  Guide Sequence
guaaucccagcacuuuggga

SEQ ID NO: 13010 - RNA, 20 nt, Artificial Sequence
  Guide Sequence
guauucccccauuucacaga

SEQ ID NO: 13011 - RNA, 20 nt, Artificial Sequence
  Guide Sequence
gucaagggggucucugcugg

SEQ ID NO: 13012 - RNA, 20 nt, Artificial Sequence
  Guide Sequence
gucucaagggaguggccagg

SEQ ID NO: 13013 - RNA, 20 nt, Artificial Sequence
  Guide Sequence
gucucugcuggggcacuuug

SEQ ID NO: 13014 - RNA, 20 nt, Artificial Sequence
  Guide Sequence
gugagcugagauggcgccac

SEQ ID NO: 13015 - RNA, 20 nt, Artificial Sequence
  Guide Sequence
guggccaggcacaguggcuc

SEQ ID NO: 13016 - RNA, 20 nt, Artificial Sequence
  Guide Sequence
guggcucacaccuuuaaucc

SEQ ID NO: 13017 - RNA, 20 nt, Artificial Sequence
  Guide Sequence
guggcucacacuuguaaucc

SEQ ID NO: 13018 - RNA, 20 nt, Artificial Sequence
  Guide Sequence
gugggaaaagauggaagaau

SEQ ID NO: 13019 - RNA, 20 nt, Artificial Sequence
  Guide Sequence
gugggcaccccgauuugugg

SEQ ID NO: 13020 - RNA, 20 nt, Artificial Sequence
  Guide Sequence
guggguauucccccauuuca

SEQ ID NO: 13021 - RNA, 20 nt, Artificial Sequence
  Guide Sequence
gugguuucaaaugcaucuau

SEQ ID NO: 13022 - RNA, 20 nt, Artificial Sequence
  Guide Sequence
guuagucaagggggucucug

SEQ ID NO: 13023 - RNA, 20 nt, Artificial Sequence
  Guide Sequence
guuucaaaugcaucuaucuc

SEQ ID NO: 13024 - RNA, 20 nt, Artificial Sequence
  Guide Sequence
uaaaaguuagucaagggggu

SEQ ID NO: 13025 - RNA, 20 nt, Artificial Sequence
  Guide Sequence
uaacagcuaccuaacuaccc

SEQ ID NO: 13026 - RNA, 20 nt, Artificial Sequence
  Guide Sequence
uaacuacccaccacaggugg

SEQ ID NO: 13027 - RNA, 20 nt, Artificial Sequence
  Guide Sequence
uaaucccagcacucuggaag

SEQ ID NO: 13028 - RNA, 20 nt, Artificial Sequence
  Guide Sequence
uaaucccagcacuuugggag

SEQ ID NO: 13029 - RNA, 20 nt, Artificial Sequence
  Guide Sequence
uaauucucacuguggguauu

SEQ ID NO: 13030 - RNA, 20 nt, Artificial Sequence
  Guide Sequence
uacccaccacaggugggcac

SEQ ID NO: 13031 - RNA, 20 nt, Artificial Sequence
  Guide Sequence
uaccuaacuacccaccacag

SEQ ID NO: 13032 - RNA, 20 nt, Artificial Sequence
  Guide Sequence
uagucaagggggucucugcu

SEQ ID NO: 13033 - RNA, 20 nt, Artificial Sequence
  Guide Sequence
uaucucaucuaauucucacu

SEQ ID NO: 13034 - RNA, 20 nt, Artificial Sequence
  Guide Sequence
uauucccccauuucacagac

SEQ ID NO: 13035 - RNA, 20 nt, Artificial Sequence
  Guide Sequence
ucaaaaaagagacccagacc

SEQ ID NO: 13036 - RNA, 20 nt, Artificial Sequence
  Guide Sequence
ucaaaugcaucuaucucauc

SEQ ID NO: 13037 - RNA, 20 nt, Artificial Sequence
  Guide Sequence
ucaagagacccaaaccagac

SEQ ID NO: 13038 - RNA, 20 nt, Artificial Sequence
  Guide Sequence
ucaagggaguggccaggcac

SEQ ID NO: 13039 - RNA, 20 nt, Artificial Sequence
  Guide Sequence
ucaagggggucucugcuggg

SEQ ID NO: 13040 - RNA, 20 nt, Artificial Sequence
  Guide Sequence
ucacaccuuuaaucccagca

SEQ ID NO: 13041 - RNA, 20 nt, Artificial Sequence
  Guide Sequence
ucacacuuguaaucccagca

SEQ ID NO: 13042 - RNA, 20 nt, Artificial Sequence
  Guide Sequence
ucacccaagggaagggagga

SEQ ID NO: 13043 - RNA, 20 nt, Artificial Sequence
  Guide Sequence
ucacccugggcccccucacc

SEQ ID NO: 13044 - RNA, 20 nt, Artificial Sequence
  Guide Sequence
ucacuguggguauuccccca

SEQ ID NO: 13045 - RNA, 20 nt, Artificial Sequence
  Guide Sequence
ucaucuaauucucacugugg

SEQ ID NO: 13046 - RNA, 20 nt, Artificial Sequence
  Guide Sequence
ucaugccccugaagaacaau

SEQ ID NO: 13047 - RNA, 20 nt, Artificial Sequence
  Guide Sequence
ucauuugaacccagaaggcg

SEQ ID NO: 13048 - RNA, 20 nt, Artificial Sequence
  Guide Sequence
uccagccugggcgacagagc

SEQ ID NO: 13049 - RNA, 20 nt, Artificial Sequence
  Guide Sequence
ucccagcacucuggaaggcc

SEQ ID NO: 13050 - RNA, 20 nt, Artificial Sequence
  Guide Sequence
ucccagcacuuugggaggcu

SEQ ID NO: 13051 - RNA, 20 nt, Artificial Sequence
  Guide Sequence
ucccccauuucacagacgug

SEQ ID NO: 13052 - RNA, 20 nt, Artificial Sequence
  Guide Sequence
uccucaugccccugaagaac

SEQ ID NO: 13053 - RNA, 20 nt, Artificial Sequence
  Guide Sequence
ucuaauucucacugugggua

SEQ ID NO: 13054 - RNA, 20 nt, Artificial Sequence
  Guide Sequence
ucuaucucaucuaauucuca

SEQ ID NO: 13055 - RNA, 20 nt, Artificial Sequence
  Guide Sequence
ucucaagggaguggccaggc

SEQ ID NO: 13056 - RNA, 20 nt, Artificial Sequence
  Guide Sequence
ucucacuguggguauucccc

SEQ ID NO: 13057 - RNA, 20 nt, Artificial Sequence
  Guide Sequence
ucucaucuaauucucacugu

SEQ ID NO: 13058 - RNA, 20 nt, Artificial Sequence
  Guide Sequence
ucucugcuggggcacuuugu

SEQ ID NO: 13059 - RNA, 20 nt, Artificial Sequence
  Guide Sequence
ucugcuggggcacuuuguaa

SEQ ID NO: 13060 - RNA, 20 nt, Artificial Sequence
  Guide Sequence
ucuggaaggccgaggcaggu

SEQ ID NO: 13061 - RNA, 20 nt, Artificial Sequence
  Guide Sequence
ucuuccucaugccccugaag

SEQ ID NO: 13062 - RNA, 20 nt, Artificial Sequence
  Guide Sequence
ugaacccagaaggcggagau

SEQ ID NO: 13063 - RNA, 20 nt, Artificial Sequence
  Guide Sequence
ugaagaacaaucaagagacc

SEQ ID NO: 13064 - RNA, 20 nt, Artificial Sequence
  Guide Sequence
ugagauggcgccacugcacu

SEQ ID NO: 13065 - RNA, 20 nt, Artificial Sequence
  Guide Sequence
ugagcugagauggcgccacu

SEQ ID NO: 13066 - RNA, 20 nt, Artificial Sequence
  Guide Sequence
ugaggcaggagaaucauuug

SEQ ID NO: 13067 - RNA, 20 nt, Artificial Sequence
  Guide Sequence
ugcacuccagccugggcgac

SEQ ID NO: 13068 - RNA, 20 nt, Artificial Sequence
  Guide Sequence
ugcagugagcugagauggcg

SEQ ID NO: 13069 - RNA, 20 nt, Artificial Sequence
  Guide Sequence
ugcaucuaucucaucuaauu

SEQ ID NO: 13070 - RNA, 20 nt, Artificial Sequence
  Guide Sequence
ugccccugaagaacaaucaa

SEQ ID NO: 13071 - RNA, 20 nt, Artificial Sequence
  Guide Sequence
ugcuggggcacuuuguaaca

SEQ ID NO: 13072 - RNA, 20 nt, Artificial Sequence
  Guide Sequence
uggaagaauaaaaguuaguc

SEQ ID NO: 13073 - RNA, 20 nt, Artificial Sequence
  Guide Sequence
uggccaggcacaguggcuca

SEQ ID NO: 13074 - RNA, 20 nt, Artificial Sequence
  Guide Sequence
uggcgccacugcacuccagc

SEQ ID NO: 13075 - RNA, 20 nt, Artificial Sequence
  Guide Sequence
uggcucacaccuuuaauccc

SEQ ID NO: 13076 - RNA, 20 nt, Artificial Sequence
  Guide Sequence
uggcucacacuuguaauccc

SEQ ID NO: 13077 - RNA, 20 nt, Artificial Sequence
  Guide Sequence
ugggaaaagauggaagaaua

SEQ ID NO: 13078 - RNA, 20 nt, Artificial Sequence
  Guide Sequence
ugggaggcugaggcaggaga

SEQ ID NO: 13079 - RNA, 20 nt, Artificial Sequence
  Guide Sequence
ugggcaccccgauuuguggu

SEQ ID NO: 13080 - RNA, 20 nt, Artificial Sequence
  Guide Sequence
ugggcccccucacccaaggg

SEQ ID NO: 13081 - RNA, 20 nt, Artificial Sequence
  Guide Sequence
ugggcgacagagcaagagac

SEQ ID NO: 13082 - RNA, 20 nt, Artificial Sequence
  Guide Sequence
uggggcacuuuguaacagcu

SEQ ID NO: 13083 - RNA, 20 nt, Artificial Sequence
  Guide Sequence
uggguauucccccauuucac

SEQ ID NO: 13084 - RNA, 20 nt, Artificial Sequence
  Guide Sequence
ugguuucaaaugcaucuauc

SEQ ID NO: 13085 - RNA, 20 nt, Artificial Sequence
  Guide Sequence
uguaacagcuaccuaacuac

SEQ ID NO: 13086 - RNA, 20 nt, Artificial Sequence
  Guide Sequence
uguaaucccagcacuuuggg

SEQ ID NO: 13087 - RNA, 20 nt, Artificial Sequence
  Guide Sequence
ugugggaaaagauggaagaa

SEQ ID NO: 13088 - RNA, 20 nt, Artificial Sequence
  Guide Sequence
uguggguauucccccauuuc

SEQ ID NO: 13089 - RNA, 20 nt, Artificial Sequence
  Guide Sequence
ugugguuucaaaugcaucua

SEQ ID NO: 13090 - RNA, 20 nt, Artificial Sequence
  Guide Sequence
uuaaucccagcacucuggaa

SEQ ID NO: 13091 - RNA, 20 nt, Artificial Sequence
  Guide Sequence
uuagucaagggggucucugc

SEQ ID NO: 13092 - RNA, 20 nt, Artificial Sequence
  Guide Sequence
uucaaaugcaucuaucucau

SEQ ID NO: 13093 - RNA, 20 nt, Artificial Sequence
  Guide Sequence
uucccccauuucacagacgu

SEQ ID NO: 13094 - RNA, 20 nt, Artificial Sequence
  Guide Sequence
uuccucaugccccugaagaa

SEQ ID NO: 13095 - RNA, 20 nt, Artificial Sequence
  Guide Sequence
uucucacuguggguauuccc

SEQ ID NO: 13096 - RNA, 20 nt, Artificial Sequence
  Guide Sequence
uugaacccagaaggcggaga

SEQ ID NO: 13097 - RNA, 20 nt, Artificial Sequence
  Guide Sequence
uugcagugagcugagauggc

SEQ ID NO: 13098 - RNA, 20 nt, Artificial Sequence
  Guide Sequence
uugggaggcugaggcaggag

SEQ ID NO: 13099 - RNA, 20 nt, Artificial Sequence
  Guide Sequence
uuguaacagcuaccuaacua

SEQ ID NO: 13100 - RNA, 20 nt, Artificial Sequence
  Guide Sequence
uuguaaucccagcacuuugg

SEQ ID NO: 13101 - RNA, 20 nt, Artificial Sequence
  Guide Sequence
uugugguuucaaaugcaucu

SEQ ID NO: 13102 - RNA, 20 nt, Artificial Sequence
  Guide Sequence
uuuaaucccagcacucugga

SEQ ID NO: 13103 - RNA, 20 nt, Artificial Sequence
  Guide Sequence
uuucaaaugcaucuaucuca

SEQ ID NO: 13104 - RNA, 20 nt, Artificial Sequence
  Guide Sequence
uuugaacccagaaggcggag

SEQ ID NO: 13105 - RNA, 20 nt, Artificial Sequence
  Guide Sequence
uuugggaggcugaggcagga

SEQ ID NO: 13106 - RNA, 20 nt, Artificial Sequence
  Guide Sequence
uuuguaacagcuaccuaacu

SEQ ID NO: 13107 - RNA, 20 nt, Artificial Sequence
  Guide Sequence
uuugugguuucaaaugcauc

SEQ ID NO: 13108 - RNA, 21 nt, Artificial Sequence
  Guide Sequence
aaaaguuagucaagggggucu

SEQ ID NO: 13109 - RNA, 21 nt, Artificial Sequence
  Guide Sequence
aaaccagaccaggcacagugg

SEQ ID NO: 13110 - RNA, 21 nt, Artificial Sequence
  Guide Sequence
aaaguuagucaagggggucuc

SEQ ID NO: 13111 - RNA, 21 nt, Artificial Sequence
  Guide Sequence
aacaaucaagagacccaaacc

SEQ ID NO: 13112 - RNA, 21 nt, Artificial Sequence
  Guide Sequence
aacagcuaccuaacuacccac

SEQ ID NO: 13113 - RNA, 21 nt, Artificial Sequence
  Guide Sequence
aaccagaccaggcacaguggc

SEQ ID NO: 13114 - RNA, 21 nt, Artificial Sequence
  Guide Sequence
aacccagaaggcggagauugc

SEQ ID NO: 13115 - RNA, 21 nt, Artificial Sequence
  Guide Sequence
aacuacccaccacaggugggc

SEQ ID NO: 13116 - RNA, 21 nt, Artificial Sequence
  Guide Sequence
aagaacaaucaagagacccaa

SEQ ID NO: 13117 - RNA, 21 nt, Artificial Sequence
  Guide Sequence
aagagacccaaaccagaccag

SEQ ID NO: 13118 - RNA, 21 nt, Artificial Sequence
  Guide Sequence
aagagacucaaaaaagagacc

SEQ ID NO: 13119 - RNA, 21 nt, Artificial Sequence
  Guide Sequence
aagcgccucuuccucaugccc

SEQ ID NO: 13120 - RNA, 21 nt, Artificial Sequence
  Guide Sequence
aaggcggagauugcagugagc

SEQ ID NO: 13121 - RNA, 21 nt, Artificial Sequence
  Guide Sequence
aagggaagggaggaagcgccu

SEQ ID NO: 13122 - RNA, 21 nt, Artificial Sequence
  Guide Sequence
aagggaggaagcgccucuucc

SEQ ID NO: 13123 - RNA, 21 nt, Artificial Sequence
  Guide Sequence
aagggaguggccaggcacagu

SEQ ID NO: 13124 - RNA, 21 nt, Artificial Sequence
  Guide Sequence
aagggggucucugcuggggca

SEQ ID NO: 13125 - RNA, 21 nt, Artificial Sequence
  Guide Sequence
aaguuagucaagggggucucu

SEQ ID NO: 13126 - RNA, 21 nt, Artificial Sequence
  Guide Sequence
aauaaaaguuagucaaggggg

SEQ ID NO: 13127 - RNA, 21 nt, Artificial Sequence
  Guide Sequence
aaucaagagacccaaaccaga

SEQ ID NO: 13128 - RNA, 21 nt, Artificial Sequence
  Guide Sequence
aaucacccugggcccccucac

SEQ ID NO: 13129 - RNA, 21 nt, Artificial Sequence
  Guide Sequence
aaucauuugaacccagaaggc

SEQ ID NO: 13130 - RNA, 21 nt, Artificial Sequence
  Guide Sequence
aaucccagcacucuggaaggc

SEQ ID NO: 13131 - RNA, 21 nt, Artificial Sequence
  Guide Sequence
aaucccagcacuuugggaggc

SEQ ID NO: 13132 - RNA, 21 nt, Artificial Sequence
  Guide Sequence
aauucucacuguggguauucc

SEQ ID NO: 13133 - RNA, 21 nt, Artificial Sequence
  Guide Sequence
acaaucaagagacccaaacca

SEQ ID NO: 13134 - RNA, 21 nt, Artificial Sequence
  Guide Sequence
acaccuuuaaucccagcacuc

SEQ ID NO: 13135 - RNA, 21 nt, Artificial Sequence
  Guide Sequence
acacuuguaaucccagcacuu

SEQ ID NO: 13136 - RNA, 21 nt, Artificial Sequence
  Guide Sequence
acagagcaagagacucaaaaa

SEQ ID NO: 13137 - RNA, 21 nt, Artificial Sequence
  Guide Sequence
acagcuaccuaacuacccacc

SEQ ID NO: 13138 - RNA, 21 nt, Artificial Sequence
  Guide Sequence
acaggugggcaccccgauuug

SEQ ID NO: 13139 - RNA, 21 nt, Artificial Sequence
  Guide Sequence
acaguggcucacaccuuuaau

SEQ ID NO: 13140 - RNA, 21 nt, Artificial Sequence
  Guide Sequence
acaguggcucacacuuguaau

SEQ ID NO: 13141 - RNA, 21 nt, Artificial Sequence
  Guide Sequence
accacaggugggcaccccgau

SEQ ID NO: 13142 - RNA, 21 nt, Artificial Sequence
  Guide Sequence
accagaccaggcacaguggcu

SEQ ID NO: 13143 - RNA, 21 nt, Artificial Sequence
  Guide Sequence
accaggcacaguggcucacac

SEQ ID NO: 13144 - RNA, 21 nt, Artificial Sequence
  Guide Sequence
acccaaaccagaccaggcaca

SEQ ID NO: 13145 - RNA, 21 nt, Artificial Sequence
  Guide Sequence
acccaagggaagggaggaagc

SEQ ID NO: 13146 - RNA, 21 nt, Artificial Sequence
  Guide Sequence
acccaccacaggugggcaccc

SEQ ID NO: 13147 - RNA, 21 nt, Artificial Sequence
  Guide Sequence
acccagaaggcggagauugca

SEQ ID NO: 13148 - RNA, 21 nt, Artificial Sequence
  Guide Sequence
accccgauuugugguuucaaa

SEQ ID NO: 13149 - RNA, 21 nt, Artificial Sequence
  Guide Sequence
acccugggcccccucacccaa

SEQ ID NO: 13150 - RNA, 21 nt, Artificial Sequence
  Guide Sequence
accuaacuacccaccacaggu

SEQ ID NO: 13151 - RNA, 21 nt, Artificial Sequence
  Guide Sequence
accuuuaaucccagcacucug

SEQ ID NO: 13152 - RNA, 21 nt, Artificial Sequence
  Guide Sequence
acuacccaccacaggugggca

SEQ ID NO: 13153 - RNA, 21 nt, Artificial Sequence
  Guide Sequence
acucaaaaaagagacccagac

SEQ ID NO: 13154 - RNA, 21 nt, Artificial Sequence
  Guide Sequence
acuccagccugggcgacagag

SEQ ID NO: 13155 - RNA, 21 nt, Artificial Sequence
  Guide Sequence
acucuggaaggccgaggcagg

SEQ ID NO: 13156 - RNA, 21 nt, Artificial Sequence
  Guide Sequence
acugcacuccagccugggcga

SEQ ID NO: 13157 - RNA, 21 nt, Artificial Sequence
  Guide Sequence
acuguggguauucccccauuu

SEQ ID NO: 13158 - RNA, 21 nt, Artificial Sequence
  Guide Sequence
acuuguaaucccagcacuuug

SEQ ID NO: 13159 - RNA, 21 nt, Artificial Sequence
  Guide Sequence
acuuugggaggcugaggcagg

SEQ ID NO: 13160 - RNA, 21 nt, Artificial Sequence
  Guide Sequence
acuuuguaacagcuaccuaac

SEQ ID NO: 13161 - RNA, 21 nt, Artificial Sequence
  Guide Sequence
agaacaaucaagagacccaaa

SEQ ID NO: 13162 - RNA, 21 nt, Artificial Sequence
  Guide Sequence
agaaggcggagauugcaguga

SEQ ID NO: 13163 - RNA, 21 nt, Artificial Sequence
  Guide Sequence
agaauaaaaguuagucaaggg

SEQ ID NO: 13164 - RNA, 21 nt, Artificial Sequence
  Guide Sequence
agaaucauuugaacccagaag

SEQ ID NO: 13165 - RNA, 21 nt, Artificial Sequence
  Guide Sequence
agaccaggcacaguggcucac

SEQ ID NO: 13166 - RNA, 21 nt, Artificial Sequence
  Guide Sequence
agacccaaaccagaccaggca

SEQ ID NO: 13167 - RNA, 21 nt, Artificial Sequence
  Guide Sequence
agacucaaaaaagagacccag

SEQ ID NO: 13168 - RNA, 21 nt, Artificial Sequence
  Guide Sequence
agagacccaaaccagaccagg

SEQ ID NO: 13169 - RNA, 21 nt, Artificial Sequence
  Guide Sequence
agagacucaaaaaagagaccc

SEQ ID NO: 13170 - RNA, 21 nt, Artificial Sequence
  Guide Sequence
agagcaagagacucaaaaaag

SEQ ID NO: 13171 - RNA, 21 nt, Artificial Sequence
  Guide Sequence
agauggcgccacugcacucca

SEQ ID NO: 13172 - RNA, 21 nt, Artificial Sequence
  Guide Sequence
agauugcagugagcugagaug

SEQ ID NO: 13173 - RNA, 21 nt, Artificial Sequence
  Guide Sequence
agcaagagacucaaaaaagag

SEQ ID NO: 13174 - RNA, 21 nt, Artificial Sequence
  Guide Sequence
agcacucuggaaggccgaggc

SEQ ID NO: 13175 - RNA, 21 nt, Artificial Sequence
  Guide Sequence
agcacuuugggaggcugaggc

SEQ ID NO: 13176 - RNA, 21 nt, Artificial Sequence
  Guide Sequence
agccugggcgacagagcaaga

SEQ ID NO: 13177 - RNA, 21 nt, Artificial Sequence
  Guide Sequence
agcgccucuuccucaugcccc

SEQ ID NO: 13178 - RNA, 21 nt, Artificial Sequence
  Guide Sequence
agcuaccuaacuacccaccac

SEQ ID NO: 13179 - RNA, 21 nt, Artificial Sequence
  Guide Sequence
agcugagauggcgccacugca

SEQ ID NO: 13180 - RNA, 21 nt, Artificial Sequence
  Guide Sequence
aggaagcgccucuuccucaug

SEQ ID NO: 13181 - RNA, 21 nt, Artificial Sequence
  Guide Sequence
aggagaaucauuugaacccag

SEQ ID NO: 13182 - RNA, 21 nt, Artificial Sequence
  Guide Sequence
aggcacaguggcucacaccuu

SEQ ID NO: 13183 - RNA, 21 nt, Artificial Sequence
  Guide Sequence
aggcacaguggcucacacuug

SEQ ID NO: 13184 - RNA, 21 nt, Artificial Sequence
  Guide Sequence
aggcaggagaaucauuugaac

SEQ ID NO: 13185 - RNA, 21 nt, Artificial Sequence
  Guide Sequence
aggcggagauugcagugagcu

SEQ ID NO: 13186 - RNA, 21 nt, Artificial Sequence
  Guide Sequence
aggcugaggcaggagaaucau

SEQ ID NO: 13187 - RNA, 21 nt, Artificial Sequence
  Guide Sequence
agggaagggaggaagcgccuc

SEQ ID NO: 13188 - RNA, 21 nt, Artificial Sequence
  Guide Sequence
agggaggaagcgccucuuccu

SEQ ID NO: 13189 - RNA, 21 nt, Artificial Sequence
  Guide Sequence
agggaguggccaggcacagug

SEQ ID NO: 13190 - RNA, 21 nt, Artificial Sequence
  Guide Sequence
agggggucucugcuggggcac

SEQ ID NO: 13191 - RNA, 21 nt, Artificial Sequence
  Guide Sequence
aggugggcaccccgauuugug

SEQ ID NO: 13192 - RNA, 21 nt, Artificial Sequence
  Guide Sequence
agucaagggggucucugcugg

SEQ ID NO: 13193 - RNA, 21 nt, Artificial Sequence
  Guide Sequence
agucucaagggaguggccagg

SEQ ID NO: 13194 - RNA, 21 nt, Artificial Sequence
  Guide Sequence
agugagcugagauggcgccac

SEQ ID NO: 13195 - RNA, 21 nt, Artificial Sequence
  Guide Sequence
aguggccaggcacaguggcuc

SEQ ID NO: 13196 - RNA, 21 nt, Artificial Sequence
  Guide Sequence
aguggcucacaccuuuaaucc

SEQ ID NO: 13197 - RNA, 21 nt, Artificial Sequence
  Guide Sequence
aguggcucacacuuguaaucc

SEQ ID NO: 13198 - RNA, 21 nt, Artificial Sequence
  Guide Sequence
aguuagucaagggggucucug

SEQ ID NO: 13199 - RNA, 21 nt, Artificial Sequence
  Guide Sequence
auaaaaguuagucaagggggu

SEQ ID NO: 13200 - RNA, 21 nt, Artificial Sequence
  Guide Sequence
aucaagagacccaaaccagac

SEQ ID NO: 13201 - RNA, 21 nt, Artificial Sequence
  Guide Sequence
aucacccugggcccccucacc

SEQ ID NO: 13202 - RNA, 21 nt, Artificial Sequence
  Guide Sequence
aucauuugaacccagaaggcg

SEQ ID NO: 13203 - RNA, 21 nt, Artificial Sequence
  Guide Sequence
aucccagcacucuggaaggcc

SEQ ID NO: 13204 - RNA, 21 nt, Artificial Sequence
  Guide Sequence
aucccagcacuuugggaggcu

SEQ ID NO: 13205 - RNA, 21 nt, Artificial Sequence
  Guide Sequence
aucuaauucucacugugggua

SEQ ID NO: 13206 - RNA, 21 nt, Artificial Sequence
  Guide Sequence
aucucaucuaauucucacugu

SEQ ID NO: 13207 - RNA, 21 nt, Artificial Sequence
  Guide Sequence
augccccugaagaacaaucaa

SEQ ID NO: 13208 - RNA, 21 nt, Artificial Sequence
  Guide Sequence
auggcgccacugcacuccagc

SEQ ID NO: 13209 - RNA, 21 nt, Artificial Sequence
  Guide Sequence
auucccccauuucacagacgu

SEQ ID NO: 13210 - RNA, 21 nt, Artificial Sequence
  Guide Sequence
auucucacuguggguauuccc

SEQ ID NO: 13211 - RNA, 21 nt, Artificial Sequence
  Guide Sequence
auugcagugagcugagauggc

SEQ ID NO: 13212 - RNA, 21 nt, Artificial Sequence
  Guide Sequence
auuugaacccagaaggcggag

SEQ ID NO: 13213 - RNA, 21 nt, Artificial Sequence
  Guide Sequence
auuugugguuucaaaugcauc

SEQ ID NO: 13214 - RNA, 21 nt, Artificial Sequence
  Guide Sequence
caaaccagaccaggcacagug

SEQ ID NO: 13215 - RNA, 21 nt, Artificial Sequence
  Guide Sequence
caaaugcaucuaucucaucua

SEQ ID NO: 13216 - RNA, 21 nt, Artificial Sequence
  Guide Sequence
caagagacccaaaccagacca

SEQ ID NO: 13217 - RNA, 21 nt, Artificial Sequence
  Guide Sequence
caagagacucaaaaaagagac

SEQ ID NO: 13218 - RNA, 21 nt, Artificial Sequence
  Guide Sequence
caagggaagggaggaagcgcc

SEQ ID NO: 13219 - RNA, 21 nt, Artificial Sequence
  Guide Sequence
caagggaguggccaggcacag

SEQ ID NO: 13220 - RNA, 21 nt, Artificial Sequence
  Guide Sequence
caagggggucucugcuggggc

SEQ ID NO: 13221 - RNA, 21 nt, Artificial Sequence
  Guide Sequence
caaucaagagacccaaaccag

SEQ ID NO: 13222 - RNA, 21 nt, Artificial Sequence
  Guide Sequence
cacaccuuuaaucccagcacu

SEQ ID NO: 13223 - RNA, 21 nt, Artificial Sequence
  Guide Sequence
cacacuuguaaucccagcacu

SEQ ID NO: 13224 - RNA, 21 nt, Artificial Sequence
  Guide Sequence
cacaggugggcaccccgauuu

SEQ ID NO: 13225 - RNA, 21 nt, Artificial Sequence
  Guide Sequence
cacaguggcucacaccuuuaa

SEQ ID NO: 13226 - RNA, 21 nt, Artificial Sequence
  Guide Sequence
cacaguggcucacacuuguaa

SEQ ID NO: 13227 - RNA, 21 nt, Artificial Sequence
  Guide Sequence
caccacaggugggcaccccga

SEQ ID NO: 13228 - RNA, 21 nt, Artificial Sequence
  Guide Sequence
cacccaagggaagggaggaag

SEQ ID NO: 13229 - RNA, 21 nt, Artificial Sequence
  Guide Sequence
caccccgauuugugguuucaa

SEQ ID NO: 13230 - RNA, 21 nt, Artificial Sequence
  Guide Sequence
cacccugggcccccucaccca

SEQ ID NO: 13231 - RNA, 21 nt, Artificial Sequence
  Guide Sequence
caccuuuaaucccagcacucu

SEQ ID NO: 13232 - RNA, 21 nt, Artificial Sequence
  Guide Sequence
cacuccagccugggcgacaga

SEQ ID NO: 13233 - RNA, 21 nt, Artificial Sequence
  Guide Sequence
cacucuggaaggccgaggcag

SEQ ID NO: 13234 - RNA, 21 nt, Artificial Sequence
  Guide Sequence
cacugcacuccagccugggcg

SEQ ID NO: 13235 - RNA, 21 nt, Artificial Sequence
  Guide Sequence
cacuguggguauucccccauu

SEQ ID NO: 13236 - RNA, 21 nt, Artificial Sequence
  Guide Sequence
cacuuguaaucccagcacuuu

SEQ ID NO: 13237 - RNA, 21 nt, Artificial Sequence
  Guide Sequence
cacuuugggaggcugaggcag

SEQ ID NO: 13238 - RNA, 21 nt, Artificial Sequence
  Guide Sequence
cacuuuguaacagcuaccuaa

SEQ ID NO: 13239 - RNA, 21 nt, Artificial Sequence
  Guide Sequence
cagaaggcggagauugcagug

SEQ ID NO: 13240 - RNA, 21 nt, Artificial Sequence
  Guide Sequence
cagaccaggcacaguggcuca

SEQ ID NO: 13241 - RNA, 21 nt, Artificial Sequence
  Guide Sequence
cagagcaagagacucaaaaaa

SEQ ID NO: 13242 - RNA, 21 nt, Artificial Sequence
  Guide Sequence
cagcacucuggaaggccgagg

SEQ ID NO: 13243 - RNA, 21 nt, Artificial Sequence
  Guide Sequence
cagcacuuugggaggcugagg

SEQ ID NO: 13244 - RNA, 21 nt, Artificial Sequence
  Guide Sequence
cagccugggcgacagagcaag

SEQ ID NO: 13245 - RNA, 21 nt, Artificial Sequence
  Guide Sequence
cagcuaccuaacuacccacca

SEQ ID NO: 13246 - RNA, 21 nt, Artificial Sequence
  Guide Sequence
caggagaaucauuugaaccca

SEQ ID NO: 13247 - RNA, 21 nt, Artificial Sequence
  Guide Sequence
caggcacaguggcucacaccu

SEQ ID NO: 13248 - RNA, 21 nt, Artificial Sequence
  Guide Sequence
caggcacaguggcucacacuu

SEQ ID NO: 13249 - RNA, 21 nt, Artificial Sequence
  Guide Sequence
caggugggcaccccgauuugu

SEQ ID NO: 13250 - RNA, 21 nt, Artificial Sequence
  Guide Sequence
cagugagcugagauggcgcca

SEQ ID NO: 13251 - RNA, 21 nt, Artificial Sequence
  Guide Sequence
caguggcucacaccuuuaauc

SEQ ID NO: 13252 - RNA, 21 nt, Artificial Sequence
  Guide Sequence
caguggcucacacuuguaauc

SEQ ID NO: 13253 - RNA, 21 nt, Artificial Sequence
  Guide Sequence
caucuaauucucacugugggu

SEQ ID NO: 13254 - RNA, 21 nt, Artificial Sequence
  Guide Sequence
caucuaucucaucuaauucuc

SEQ ID NO: 13255 - RNA, 21 nt, Artificial Sequence
  Guide Sequence
caugccccugaagaacaauca

SEQ ID NO: 13256 - RNA, 21 nt, Artificial Sequence
  Guide Sequence
cauuugaacccagaaggcgga

SEQ ID NO: 13257 - RNA, 21 nt, Artificial Sequence
  Guide Sequence
ccaaaccagaccaggcacagu

SEQ ID NO: 13258 - RNA, 21 nt, Artificial Sequence
  Guide Sequence
ccaagggaagggaggaagcgc

SEQ ID NO: 13259 - RNA, 21 nt, Artificial Sequence
  Guide Sequence
ccacaggugggcaccccgauu

SEQ ID NO: 13260 - RNA, 21 nt, Artificial Sequence
  Guide Sequence
ccaccacaggugggcaccccg

SEQ ID NO: 13261 - RNA, 21 nt, Artificial Sequence
  Guide Sequence
ccacugcacuccagccugggc

SEQ ID NO: 13262 - RNA, 21 nt, Artificial Sequence
  Guide Sequence
ccagaaggcggagauugcagu

SEQ ID NO: 13263 - RNA, 21 nt, Artificial Sequence
  Guide Sequence
ccagaccaggcacaguggcuc

SEQ ID NO: 13264 - RNA, 21 nt, Artificial Sequence
  Guide Sequence
ccagcacucuggaaggccgag

SEQ ID NO: 13265 - RNA, 21 nt, Artificial Sequence
  Guide Sequence
ccagcacuuugggaggcugag

SEQ ID NO: 13266 - RNA, 21 nt, Artificial Sequence
  Guide Sequence
ccagccugggcgacagagcaa

SEQ ID NO: 13267 - RNA, 21 nt, Artificial Sequence
  Guide Sequence
ccaggcacaguggcucacacc

SEQ ID NO: 13268 - RNA, 21 nt, Artificial Sequence
  Guide Sequence
ccaggcacaguggcucacacu

SEQ ID NO: 13269 - RNA, 21 nt, Artificial Sequence
  Guide Sequence
cccaaaccagaccaggcacag

SEQ ID NO: 13270 - RNA, 21 nt, Artificial Sequence
  Guide Sequence
cccaagggaagggaggaagcg

SEQ ID NO: 13271 - RNA, 21 nt, Artificial Sequence
  Guide Sequence
cccaccacaggugggcacccc

SEQ ID NO: 13272 - RNA, 21 nt, Artificial Sequence
  Guide Sequence
cccagaaggcggagauugcag

SEQ ID NO: 13273 - RNA, 21 nt, Artificial Sequence
  Guide Sequence
cccagcacucuggaaggccga

SEQ ID NO: 13274 - RNA, 21 nt, Artificial Sequence
  Guide Sequence
cccagcacuuugggaggcuga

SEQ ID NO: 13275 - RNA, 21 nt, Artificial Sequence
  Guide Sequence
ccccauuucacagacguggaa

SEQ ID NO: 13276 - RNA, 21 nt, Artificial Sequence
  Guide Sequence
cccccauuucacagacgugga

SEQ ID NO: 13277 - RNA, 21 nt, Artificial Sequence
  Guide Sequence
cccccucacccaagggaaggg

SEQ ID NO: 13278 - RNA, 21 nt, Artificial Sequence
  Guide Sequence
ccccgauuugugguuucaaau

SEQ ID NO: 13279 - RNA, 21 nt, Artificial Sequence
  Guide Sequence
ccccucacccaagggaaggga

SEQ ID NO: 13280 - RNA, 21 nt, Artificial Sequence
  Guide Sequence
ccccugaagaacaaucaagag

SEQ ID NO: 13281 - RNA, 21 nt, Artificial Sequence
  Guide Sequence
cccgauuugugguuucaaaug

SEQ ID NO: 13282 - RNA, 21 nt, Artificial Sequence
  Guide Sequence
cccucacccaagggaagggag

SEQ ID NO: 13283 - RNA, 21 nt, Artificial Sequence
  Guide Sequence
cccugaagaacaaucaagaga

SEQ ID NO: 13284 - RNA, 21 nt, Artificial Sequence
  Guide Sequence
cccugggcccccucacccaag

SEQ ID NO: 13285 - RNA, 21 nt, Artificial Sequence
  Guide Sequence
ccgauuugugguuucaaaugc

SEQ ID NO: 13286 - RNA, 21 nt, Artificial Sequence
  Guide Sequence
ccuaacuacccaccacaggug

SEQ ID NO: 13287 - RNA, 21 nt, Artificial Sequence
  Guide Sequence
ccucacccaagggaagggagg

SEQ ID NO: 13288 - RNA, 21 nt, Artificial Sequence
  Guide Sequence
ccucaugccccugaagaacaa

SEQ ID NO: 13289 - RNA, 21 nt, Artificial Sequence
  Guide Sequence
ccucuuccucaugccccugaa

SEQ ID NO: 13290 - RNA, 21 nt, Artificial Sequence
  Guide Sequence
ccugaagaacaaucaagagac

SEQ ID NO: 13291 - RNA, 21 nt, Artificial Sequence
  Guide Sequence
ccugggcccccucacccaagg

SEQ ID NO: 13292 - RNA, 21 nt, Artificial Sequence
  Guide Sequence
ccugggcgacagagcaagaga

SEQ ID NO: 13293 - RNA, 21 nt, Artificial Sequence
  Guide Sequence
ccuuuaaucccagcacucugg

SEQ ID NO: 13294 - RNA, 21 nt, Artificial Sequence
  Guide Sequence
cgacagagcaagagacucaaa

SEQ ID NO: 13295 - RNA, 21 nt, Artificial Sequence
  Guide Sequence
cgauuugugguuucaaaugca

SEQ ID NO: 13296 - RNA, 21 nt, Artificial Sequence
  Guide Sequence
cgccacugcacuccagccugg

SEQ ID NO: 13297 - RNA, 21 nt, Artificial Sequence
  Guide Sequence
cgccucuuccucaugccccug

SEQ ID NO: 13298 - RNA, 21 nt, Artificial Sequence
  Guide Sequence
cggagauugcagugagcugag

SEQ ID NO: 13299 - RNA, 21 nt, Artificial Sequence
  Guide Sequence
cuaacuacccaccacaggugg

SEQ ID NO: 13300 - RNA, 21 nt, Artificial Sequence
  Guide Sequence
cuaauucucacuguggguauu

SEQ ID NO: 13301 - RNA, 21 nt, Artificial Sequence
  Guide Sequence
cuacccaccacaggugggcac

SEQ ID NO: 13302 - RNA, 21 nt, Artificial Sequence
  Guide Sequence
cuaccuaacuacccaccacag

SEQ ID NO: 13303 - RNA, 21 nt, Artificial Sequence
  Guide Sequence
cuaucucaucuaauucucacu

SEQ ID NO: 13304 - RNA, 21 nt, Artificial Sequence
  Guide Sequence
cucaaaaaagagacccagacc

SEQ ID NO: 13305 - RNA, 21 nt, Artificial Sequence
  Guide Sequence
cucaagggaguggccaggcac

SEQ ID NO: 13306 - RNA, 21 nt, Artificial Sequence
  Guide Sequence
cucacaccuuuaaucccagca

SEQ ID NO: 13307 - RNA, 21 nt, Artificial Sequence
  Guide Sequence
cucacacuuguaaucccagca

SEQ ID NO: 13308 - RNA, 21 nt, Artificial Sequence
  Guide Sequence
cucacccaagggaagggagga

SEQ ID NO: 13309 - RNA, 21 nt, Artificial Sequence
  Guide Sequence
cucacuguggguauuccccca

SEQ ID NO: 13310 - RNA, 21 nt, Artificial Sequence
  Guide Sequence
cucaucuaauucucacugugg

SEQ ID NO: 13311 - RNA, 21 nt, Artificial Sequence
  Guide Sequence
cucaugccccugaagaacaau

SEQ ID NO: 13312 - RNA, 21 nt, Artificial Sequence
  Guide Sequence
cuccagccugggcgacagagc

SEQ ID NO: 13313 - RNA, 21 nt, Artificial Sequence
  Guide Sequence
cucugcuggggcacuuuguaa

SEQ ID NO: 13314 - RNA, 21 nt, Artificial Sequence
  Guide Sequence
cucuggaaggccgaggcaggu

SEQ ID NO: 13315 - RNA, 21 nt, Artificial Sequence
  Guide Sequence
cucuuccucaugccccugaag

SEQ ID NO: 13316 - RNA, 21 nt, Artificial Sequence
  Guide Sequence
cugaagaacaaucaagagacc

SEQ ID NO: 13317 - RNA, 21 nt, Artificial Sequence
  Guide Sequence
cugagauggcgccacugcacu

SEQ ID NO: 13318 - RNA, 21 nt, Artificial Sequence
  Guide Sequence
cugaggcaggagaaucauuug

SEQ ID NO: 13319 - RNA, 21 nt, Artificial Sequence
  Guide Sequence
cugcacuccagccugggcgac

SEQ ID NO: 13320 - RNA, 21 nt, Artificial Sequence
  Guide Sequence
cugcuggggcacuuuguaaca

SEQ ID NO: 13321 - RNA, 21 nt, Artificial Sequence
  Guide Sequence
cugggcccccucacccaaggg

SEQ ID NO: 13322 - RNA, 21 nt, Artificial Sequence
  Guide Sequence
cugggcgacagagcaagagac

SEQ ID NO: 13323 - RNA, 21 nt, Artificial Sequence
  Guide Sequence
cuggggcacuuuguaacagcu

SEQ ID NO: 13324 - RNA, 21 nt, Artificial Sequence
  Guide Sequence
cugugggaaaagauggaagaa

SEQ ID NO: 13325 - RNA, 21 nt, Artificial Sequence
  Guide Sequence
cuguggguauucccccauuuc

SEQ ID NO: 13326 - RNA, 21 nt, Artificial Sequence
  Guide Sequence
cuuccucaugccccugaagaa

SEQ ID NO: 13327 - RNA, 21 nt, Artificial Sequence
  Guide Sequence
cuuguaaucccagcacuuugg

SEQ ID NO: 13328 - RNA, 21 nt, Artificial Sequence
  Guide Sequence
cuuuaaucccagcacucugga

SEQ ID NO: 13329 - RNA, 21 nt, Artificial Sequence
  Guide Sequence
cuuugggaggcugaggcagga

SEQ ID NO: 13330 - RNA, 21 nt, Artificial Sequence
  Guide Sequence
cuuuguaacagcuaccuaacu

SEQ ID NO: 13331 - RNA, 21 nt, Artificial Sequence
  Guide Sequence
gaacaaucaagagacccaaac

SEQ ID NO: 13332 - RNA, 21 nt, Artificial Sequence
  Guide Sequence
gaacccagaaggcggagauug

SEQ ID NO: 13333 - RNA, 21 nt, Artificial Sequence
  Guide Sequence
gaagaacaaucaagagaccca

SEQ ID NO: 13334 - RNA, 21 nt, Artificial Sequence
  Guide Sequence
gaagcgccucuuccucaugcc

SEQ ID NO: 13335 - RNA, 21 nt, Artificial Sequence
  Guide Sequence
gaaggcggagauugcagugag

SEQ ID NO: 13336 - RNA, 21 nt, Artificial Sequence
  Guide Sequence
gaagggaggaagcgccucuuc

SEQ ID NO: 13337 - RNA, 21 nt, Artificial Sequence
  Guide Sequence
gaauaaaaguuagucaagggg

SEQ ID NO: 13338 - RNA, 21 nt, Artificial Sequence
  Guide Sequence
gaaucauuugaacccagaagg

SEQ ID NO: 13339 - RNA, 21 nt, Artificial Sequence
  Guide Sequence
gacagagcaagagacucaaaa

SEQ ID NO: 13340 - RNA, 21 nt, Artificial Sequence
  Guide Sequence
gaccaggcacaguggcucaca

SEQ ID NO: 13341 - RNA, 21 nt, Artificial Sequence
  Guide Sequence
gacccaaaccagaccaggcac

SEQ ID NO: 13342 - RNA, 21 nt, Artificial Sequence
  Guide Sequence
gacucaaaaaagagacccaga

SEQ ID NO: 13343 - RNA, 21 nt, Artificial Sequence
  Guide Sequence
gagaaucauuugaacccagaa

SEQ ID NO: 13344 - RNA, 21 nt, Artificial Sequence
  Guide Sequence
gagacccaaaccagaccaggc

SEQ ID NO: 13345 - RNA, 21 nt, Artificial Sequence
  Guide Sequence
gagacucaaaaaagagaccca

SEQ ID NO: 13346 - RNA, 21 nt, Artificial Sequence
  Guide Sequence
gagauggcgccacugcacucc

SEQ ID NO: 13347 - RNA, 21 nt, Artificial Sequence
  Guide Sequence
gagauugcagugagcugagau

SEQ ID NO: 13348 - RNA, 21 nt, Artificial Sequence
  Guide Sequence
gagcaagagacucaaaaaaga

SEQ ID NO: 13349 - RNA, 21 nt, Artificial Sequence
  Guide Sequence
gagcugagauggcgccacugc

SEQ ID NO: 13350 - RNA, 21 nt, Artificial Sequence
  Guide Sequence
gaggaagcgccucuuccucau

SEQ ID NO: 13351 - RNA, 21 nt, Artificial Sequence
  Guide Sequence
gaggcaggagaaucauuugaa

SEQ ID NO: 13352 - RNA, 21 nt, Artificial Sequence
  Guide Sequence
gaggcugaggcaggagaauca

SEQ ID NO: 13353 - RNA, 21 nt, Artificial Sequence
  Guide Sequence
gaguggccaggcacaguggcu

SEQ ID NO: 13354 - RNA, 21 nt, Artificial Sequence
  Guide Sequence
gauggcgccacugcacuccag

SEQ ID NO: 13355 - RNA, 21 nt, Artificial Sequence
  Guide Sequence
gauugcagugagcugagaugg

SEQ ID NO: 13356 - RNA, 21 nt, Artificial Sequence
  Guide Sequence
gauuugugguuucaaaugcau

SEQ ID NO: 13357 - RNA, 21 nt, Artificial Sequence
  Guide Sequence
gcaagagacucaaaaaagaga

SEQ ID NO: 13358 - RNA, 21 nt, Artificial Sequence
  Guide Sequence
gcacaguggcucacaccuuua

SEQ ID NO: 13359 - RNA, 21 nt, Artificial Sequence
  Guide Sequence
gcacaguggcucacacuugua

SEQ ID NO: 13360 - RNA, 21 nt, Artificial Sequence
  Guide Sequence
gcaccccgauuugugguuuca

SEQ ID NO: 13361 - RNA, 21 nt, Artificial Sequence
  Guide Sequence
gcacuccagccugggcgacag

SEQ ID NO: 13362 - RNA, 21 nt, Artificial Sequence
  Guide Sequence
gcacucuggaaggccgaggca

SEQ ID NO: 13363 - RNA, 21 nt, Artificial Sequence
  Guide Sequence
gcacuuugggaggcugaggca

SEQ ID NO: 13364 - RNA, 21 nt, Artificial Sequence
  Guide Sequence
gcacuuuguaacagcuaccua

SEQ ID NO: 13365 - RNA, 21 nt, Artificial Sequence
  Guide Sequence
gcaggagaaucauuugaaccc

SEQ ID NO: 13366 - RNA, 21 nt, Artificial Sequence
  Guide Sequence
gcagugagcugagauggcgcc

SEQ ID NO: 13367 - RNA, 21 nt, Artificial Sequence
  Guide Sequence
gcaucuaucucaucuaauucu

SEQ ID NO: 13368 - RNA, 21 nt, Artificial Sequence
  Guide Sequence
gccacugcacuccagccuggg

SEQ ID NO: 13369 - RNA, 21 nt, Artificial Sequence
  Guide Sequence
gccaggcacaguggcucacac

SEQ ID NO: 13370 - RNA, 21 nt, Artificial Sequence
  Guide Sequence
gcccccucacccaagggaagg

SEQ ID NO: 13371 - RNA, 21 nt, Artificial Sequence
  Guide Sequence
gccccugaagaacaaucaaga

SEQ ID NO: 13372 - RNA, 21 nt, Artificial Sequence
  Guide Sequence
gccucuuccucaugccccuga

SEQ ID NO: 13373 - RNA, 21 nt, Artificial Sequence
  Guide Sequence
gccugggcgacagagcaagag

SEQ ID NO: 13374 - RNA, 21 nt, Artificial Sequence
  Guide Sequence
gcgacagagcaagagacucaa

SEQ ID NO: 13375 - RNA, 21 nt, Artificial Sequence
  Guide Sequence
gcgccacugcacuccagccug

SEQ ID NO: 13376 - RNA, 21 nt, Artificial Sequence
  Guide Sequence
gcgccucuuccucaugccccu

SEQ ID NO: 13377 - RNA, 21 nt, Artificial Sequence
  Guide Sequence
gcggagauugcagugagcuga

SEQ ID NO: 13378 - RNA, 21 nt, Artificial Sequence
  Guide Sequence
gcuaccuaacuacccaccaca

SEQ ID NO: 13379 - RNA, 21 nt, Artificial Sequence
  Guide Sequence
gcucacaccuuuaaucccagc

SEQ ID NO: 13380 - RNA, 21 nt, Artificial Sequence
  Guide Sequence
gcucacacuuguaaucccagc

SEQ ID NO: 13381 - RNA, 21 nt, Artificial Sequence
  Guide Sequence
gcugagauggcgccacugcac

SEQ ID NO: 13382 - RNA, 21 nt, Artificial Sequence
  Guide Sequence
gcugaggcaggagaaucauuu

SEQ ID NO: 13383 - RNA, 21 nt, Artificial Sequence
  Guide Sequence
gcuggggcacuuuguaacagc

SEQ ID NO: 13384 - RNA, 21 nt, Artificial Sequence
  Guide Sequence
ggaagcgccucuuccucaugc

SEQ ID NO: 13385 - RNA, 21 nt, Artificial Sequence
  Guide Sequence
ggaagggaggaagcgccucuu

SEQ ID NO: 13386 - RNA, 21 nt, Artificial Sequence
  Guide Sequence
ggagaaucauuugaacccaga

SEQ ID NO: 13387 - RNA, 21 nt, Artificial Sequence
  Guide Sequence
ggagauugcagugagcugaga

SEQ ID NO: 13388 - RNA, 21 nt, Artificial Sequence
  Guide Sequence
ggaggaagcgccucuuccuca

SEQ ID NO: 13389 - RNA, 21 nt, Artificial Sequence
  Guide Sequence
ggaggcugaggcaggagaauc

SEQ ID NO: 13390 - RNA, 21 nt, Artificial Sequence
  Guide Sequence
ggaguggccaggcacaguggc

SEQ ID NO: 13391 - RNA, 21 nt, Artificial Sequence
  Guide Sequence
ggcacaguggcucacaccuuu

SEQ ID NO: 13392 - RNA, 21 nt, Artificial Sequence
  Guide Sequence
ggcacaguggcucacacuugu

SEQ ID NO: 13393 - RNA, 21 nt, Artificial Sequence
  Guide Sequence
ggcaccccgauuugugguuuc

SEQ ID NO: 13394 - RNA, 21 nt, Artificial Sequence
  Guide Sequence
ggcacuuuguaacagcuaccu

SEQ ID NO: 13395 - RNA, 21 nt, Artificial Sequence
  Guide Sequence
ggcaggagaaucauuugaacc

SEQ ID NO: 13396 - RNA, 21 nt, Artificial Sequence
  Guide Sequence
ggccaggcacaguggcucaca

SEQ ID NO: 13397 - RNA, 21 nt, Artificial Sequence
  Guide Sequence
ggcccccucacccaagggaag

SEQ ID NO: 13398 - RNA, 21 nt, Artificial Sequence
  Guide Sequence
ggcgacagagcaagagacuca

SEQ ID NO: 13399 - RNA, 21 nt, Artificial Sequence
  Guide Sequence
ggcgccacugcacuccagccu

SEQ ID NO: 13400 - RNA, 21 nt, Artificial Sequence
  Guide Sequence
ggcggagauugcagugagcug

SEQ ID NO: 13401 - RNA, 21 nt, Artificial Sequence
  Guide Sequence
ggcucacaccuuuaaucccag

SEQ ID NO: 13402 - RNA, 21 nt, Artificial Sequence
  Guide Sequence
ggcucacacuuguaaucccag

SEQ ID NO: 13403 - RNA, 21 nt, Artificial Sequence
  Guide Sequence
ggcugaggcaggagaaucauu

SEQ ID NO: 13404 - RNA, 21 nt, Artificial Sequence
  Guide Sequence
gggaaaagauggaagaauaaa

SEQ ID NO: 13405 - RNA, 21 nt, Artificial Sequence
  Guide Sequence
gggaagggaggaagcgccucu

SEQ ID NO: 13406 - RNA, 21 nt, Artificial Sequence
  Guide Sequence
gggaggaagcgccucuuccuc

SEQ ID NO: 13407 - RNA, 21 nt, Artificial Sequence
  Guide Sequence
gggaggcugaggcaggagaau

SEQ ID NO: 13408 - RNA, 21 nt, Artificial Sequence
  Guide Sequence
gggaguggccaggcacagugg

SEQ ID NO: 13409 - RNA, 21 nt, Artificial Sequence
  Guide Sequence
gggcaccccgauuugugguuu

SEQ ID NO: 13410 - RNA, 21 nt, Artificial Sequence
  Guide Sequence
gggcacuuuguaacagcuacc

SEQ ID NO: 13411 - RNA, 21 nt, Artificial Sequence
  Guide Sequence
gggcccccucacccaagggaa

SEQ ID NO: 13412 - RNA, 21 nt, Artificial Sequence
  Guide Sequence
gggcgacagagcaagagacuc

SEQ ID NO: 13413 - RNA, 21 nt, Artificial Sequence
  Guide Sequence
ggggcacuuuguaacagcuac

SEQ ID NO: 13414 - RNA, 21 nt, Artificial Sequence
  Guide Sequence
gggggucucugcuggggcacu

SEQ ID NO: 13415 - RNA, 21 nt, Artificial Sequence
  Guide Sequence
ggggucucugcuggggcacuu

SEQ ID NO: 13416 - RNA, 21 nt, Artificial Sequence
  Guide Sequence
ggguauucccccauuucacag

SEQ ID NO: 13417 - RNA, 21 nt, Artificial Sequence
  Guide Sequence
gggucucugcuggggcacuuu

SEQ ID NO: 13418 - RNA, 21 nt, Artificial Sequence
  Guide Sequence
gguauucccccauuucacaga

SEQ ID NO: 13419 - RNA, 21 nt, Artificial Sequence
  Guide Sequence
ggucucugcuggggcacuuug

SEQ ID NO: 13420 - RNA, 21 nt, Artificial Sequence
  Guide Sequence
ggugggcaccccgauuugugg

SEQ ID NO: 13421 - RNA, 21 nt, Artificial Sequence
  Guide Sequence
gguuucaaaugcaucuaucuc

SEQ ID NO: 13422 - RNA, 21 nt, Artificial Sequence
  Guide Sequence
guaacagcuaccuaacuaccc

SEQ ID NO: 13423 - RNA, 21 nt, Artificial Sequence
  Guide Sequence
guaaucccagcacuuugggag

SEQ ID NO: 13424 - RNA, 21 nt, Artificial Sequence
  Guide Sequence
guauucccccauuucacagac

SEQ ID NO: 13425 - RNA, 21 nt, Artificial Sequence
  Guide Sequence
gucaagggggucucugcuggg

SEQ ID NO: 13426 - RNA, 21 nt, Artificial Sequence
  Guide Sequence
gucucaagggaguggccaggc

SEQ ID NO: 13427 - RNA, 21 nt, Artificial Sequence
  Guide Sequence
gucucugcuggggcacuuugu

SEQ ID NO: 13428 - RNA, 21 nt, Artificial Sequence
  Guide Sequence
gugagcugagauggcgccacu

SEQ ID NO: 13429 - RNA, 21 nt, Artificial Sequence
  Guide Sequence
guggccaggcacaguggcuca

SEQ ID NO: 13430 - RNA, 21 nt, Artificial Sequence
  Guide Sequence
guggcucacaccuuuaauccc

SEQ ID NO: 13431 - RNA, 21 nt, Artificial Sequence
  Guide Sequence
guggcucacacuuguaauccc

SEQ ID NO: 13432 - RNA, 21 nt, Artificial Sequence
  Guide Sequence
gugggaaaagauggaagaaua

SEQ ID NO: 13433 - RNA, 21 nt, Artificial Sequence
  Guide Sequence
gugggcaccccgauuuguggu

SEQ ID NO: 13434 - RNA, 21 nt, Artificial Sequence
  Guide Sequence
guggguauucccccauuucac

SEQ ID NO: 13435 - RNA, 21 nt, Artificial Sequence
  Guide Sequence
gugguuucaaaugcaucuauc

SEQ ID NO: 13436 - RNA, 21 nt, Artificial Sequence
  Guide Sequence
guuagucaagggggucucugc

SEQ ID NO: 13437 - RNA, 21 nt, Artificial Sequence
  Guide Sequence
guuucaaaugcaucuaucuca

SEQ ID NO: 13438 - RNA, 21 nt, Artificial Sequence
  Guide Sequence
uaaaaguuagucaaggggguc

SEQ ID NO: 13439 - RNA, 21 nt, Artificial Sequence
  Guide Sequence
uaacagcuaccuaacuaccca

SEQ ID NO: 13440 - RNA, 21 nt, Artificial Sequence
  Guide Sequence
uaacuacccaccacagguggg

SEQ ID NO: 13441 - RNA, 21 nt, Artificial Sequence
  Guide Sequence
uaaucccagcacucuggaagg

SEQ ID NO: 13442 - RNA, 21 nt, Artificial Sequence
  Guide Sequence
uaaucccagcacuuugggagg

SEQ ID NO: 13443 - RNA, 21 nt, Artificial Sequence
  Guide Sequence
uaauucucacuguggguauuc

SEQ ID NO: 13444 - RNA, 21 nt, Artificial Sequence
  Guide Sequence
uacccaccacaggugggcacc

SEQ ID NO: 13445 - RNA, 21 nt, Artificial Sequence
  Guide Sequence
uaccuaacuacccaccacagg

SEQ ID NO: 13446 - RNA, 21 nt, Artificial Sequence
  Guide Sequence
uagucaagggggucucugcug

SEQ ID NO: 13447 - RNA, 21 nt, Artificial Sequence
  Guide Sequence
uaucucaucuaauucucacug

SEQ ID NO: 13448 - RNA, 21 nt, Artificial Sequence
  Guide Sequence
uauucccccauuucacagacg

SEQ ID NO: 13449 - RNA, 21 nt, Artificial Sequence
  Guide Sequence
ucaaaugcaucuaucucaucu

SEQ ID NO: 13450 - RNA, 21 nt, Artificial Sequence
  Guide Sequence
ucaagagacccaaaccagacc

SEQ ID NO: 13451 - RNA, 21 nt, Artificial Sequence
  Guide Sequence
ucaagggaguggccaggcaca

SEQ ID NO: 13452 - RNA, 21 nt, Artificial Sequence
  Guide Sequence
ucaagggggucucugcugggg

SEQ ID NO: 13453 - RNA, 21 nt, Artificial Sequence
  Guide Sequence
ucacaccuuuaaucccagcac

SEQ ID NO: 13454 - RNA, 21 nt, Artificial Sequence
  Guide Sequence
ucacacuuguaaucccagcac

SEQ ID NO: 13455 - RNA, 21 nt, Artificial Sequence
  Guide Sequence
ucacccaagggaagggaggaa

SEQ ID NO: 13456 - RNA, 21 nt, Artificial Sequence
  Guide Sequence
ucacccugggcccccucaccc

SEQ ID NO: 13457 - RNA, 21 nt, Artificial Sequence
  Guide Sequence
ucacuguggguauucccccau

SEQ ID NO: 13458 - RNA, 21 nt, Artificial Sequence
  Guide Sequence
ucaucuaauucucacuguggg

SEQ ID NO: 13459 - RNA, 21 nt, Artificial Sequence
  Guide Sequence
ucaugccccugaagaacaauc

SEQ ID NO: 13460 - RNA, 21 nt, Artificial Sequence
  Guide Sequence
ucauuugaacccagaaggcgg

SEQ ID NO: 13461 - RNA, 21 nt, Artificial Sequence
  Guide Sequence
uccagccugggcgacagagca

SEQ ID NO: 13462 - RNA, 21 nt, Artificial Sequence
  Guide Sequence
ucccagcacucuggaaggccg

SEQ ID NO: 13463 - RNA, 21 nt, Artificial Sequence
  Guide Sequence
ucccagcacuuugggaggcug

SEQ ID NO: 13464 - RNA, 21 nt, Artificial Sequence
  Guide Sequence
ucccccauuucacagacgugg

SEQ ID NO: 13465 - RNA, 21 nt, Artificial Sequence
  Guide Sequence
uccucaugccccugaagaaca

SEQ ID NO: 13466 - RNA, 21 nt, Artificial Sequence
  Guide Sequence
ucuaauucucacuguggguau

SEQ ID NO: 13467 - RNA, 21 nt, Artificial Sequence
  Guide Sequence
ucuaucucaucuaauucucac

SEQ ID NO: 13468 - RNA, 21 nt, Artificial Sequence
  Guide Sequence
ucucaagggaguggccaggca

SEQ ID NO: 13469 - RNA, 21 nt, Artificial Sequence
  Guide Sequence
ucucacuguggguauuccccc

SEQ ID NO: 13470 - RNA, 21 nt, Artificial Sequence
  Guide Sequence
ucucaucuaauucucacugug

SEQ ID NO: 13471 - RNA, 21 nt, Artificial Sequence
  Guide Sequence
ucucugcuggggcacuuugua

SEQ ID NO: 13472 - RNA, 21 nt, Artificial Sequence
  Guide Sequence
ucugcuggggcacuuuguaac

SEQ ID NO: 13473 - RNA, 21 nt, Artificial Sequence
  Guide Sequence
ucuggaaggccgaggcaggug

SEQ ID NO: 13474 - RNA, 21 nt, Artificial Sequence
  Guide Sequence
ucuuccucaugccccugaaga

SEQ ID NO: 13475 - RNA, 21 nt, Artificial Sequence
  Guide Sequence
ugaacccagaaggcggagauu

SEQ ID NO: 13476 - RNA, 21 nt, Artificial Sequence
  Guide Sequence
ugaagaacaaucaagagaccc

SEQ ID NO: 13477 - RNA, 21 nt, Artificial Sequence
  Guide Sequence
ugagauggcgccacugcacuc

SEQ ID NO: 13478 - RNA, 21 nt, Artificial Sequence
  Guide Sequence
ugagcugagauggcgccacug

SEQ ID NO: 13479 - RNA, 21 nt, Artificial Sequence
  Guide Sequence
ugaggcaggagaaucauuuga

SEQ ID NO: 13480 - RNA, 21 nt, Artificial Sequence
  Guide Sequence
ugcacuccagccugggcgaca

SEQ ID NO: 13481 - RNA, 21 nt, Artificial Sequence
  Guide Sequence
ugcagugagcugagauggcgc

SEQ ID NO: 13482 - RNA, 21 nt, Artificial Sequence
  Guide Sequence
ugcaucuaucucaucuaauuc

SEQ ID NO: 13483 - RNA, 21 nt, Artificial Sequence
  Guide Sequence
ugccccugaagaacaaucaag

SEQ ID NO: 13484 - RNA, 21 nt, Artificial Sequence
  Guide Sequence
ugcuggggcacuuuguaacag

SEQ ID NO: 13485 - RNA, 21 nt, Artificial Sequence
  Guide Sequence
uggccaggcacaguggcucac

SEQ ID NO: 13486 - RNA, 21 nt, Artificial Sequence
  Guide Sequence
uggcgccacugcacuccagcc

SEQ ID NO: 13487 - RNA, 21 nt, Artificial Sequence
  Guide Sequence
uggcucacaccuuuaauccca

SEQ ID NO: 13488 - RNA, 21 nt, Artificial Sequence
  Guide Sequence
uggcucacacuuguaauccca

SEQ ID NO: 13489 - RNA, 21 nt, Artificial Sequence
  Guide Sequence
ugggaaaagauggaagaauaa

SEQ ID NO: 13490 - RNA, 21 nt, Artificial Sequence
  Guide Sequence
ugggaggcugaggcaggagaa

SEQ ID NO: 13491 - RNA, 21 nt, Artificial Sequence
  Guide Sequence
ugggcaccccgauuugugguu

SEQ ID NO: 13492 - RNA, 21 nt, Artificial Sequence
  Guide Sequence
ugggcccccucacccaaggga

SEQ ID NO: 13493 - RNA, 21 nt, Artificial Sequence
  Guide Sequence
ugggcgacagagcaagagacu

SEQ ID NO: 13494 - RNA, 21 nt, Artificial Sequence
  Guide Sequence
uggggcacuuuguaacagcua

SEQ ID NO: 13495 - RNA, 21 nt, Artificial Sequence
  Guide Sequence
uggguauucccccauuucaca

SEQ ID NO: 13496 - RNA, 21 nt, Artificial Sequence
  Guide Sequence
ugguuucaaaugcaucuaucu

SEQ ID NO: 13497 - RNA, 21 nt, Artificial Sequence
  Guide Sequence
uguaacagcuaccuaacuacc

SEQ ID NO: 13498 - RNA, 21 nt, Artificial Sequence
  Guide Sequence
uguaaucccagcacuuuggga

SEQ ID NO: 13499 - RNA, 21 nt, Artificial Sequence
  Guide Sequence
ugugggaaaagauggaagaau

SEQ ID NO: 13500 - RNA, 21 nt, Artificial Sequence
  Guide Sequence
uguggguauucccccauuuca

SEQ ID NO: 13501 - RNA, 21 nt, Artificial Sequence
  Guide Sequence
ugugguuucaaaugcaucuau

SEQ ID NO: 13502 - RNA, 21 nt, Artificial Sequence
  Guide Sequence
uuaaucccagcacucuggaag

SEQ ID NO: 13503 - RNA, 21 nt, Artificial Sequence
  Guide Sequence
uuagucaagggggucucugcu

SEQ ID NO: 13504 - RNA, 21 nt, Artificial Sequence
  Guide Sequence
uucaaaugcaucuaucucauc

SEQ ID NO: 13505 - RNA, 21 nt, Artificial Sequence
  Guide Sequence
uucccccauuucacagacgug

SEQ ID NO: 13506 - RNA, 21 nt, Artificial Sequence
  Guide Sequence
uuccucaugccccugaagaac

SEQ ID NO: 13507 - RNA, 21 nt, Artificial Sequence
  Guide Sequence
uucucacuguggguauucccc

SEQ ID NO: 13508 - RNA, 21 nt, Artificial Sequence
  Guide Sequence
uugaacccagaaggcggagau

SEQ ID NO: 13509 - RNA, 21 nt, Artificial Sequence
  Guide Sequence
uugcagugagcugagauggcg

SEQ ID NO: 13510 - RNA, 21 nt, Artificial Sequence
  Guide Sequence
uugggaggcugaggcaggaga

SEQ ID NO: 13511 - RNA, 21 nt, Artificial Sequence
  Guide Sequence
uuguaacagcuaccuaacuac

SEQ ID NO: 13512 - RNA, 21 nt, Artificial Sequence
  Guide Sequence
uuguaaucccagcacuuuggg

SEQ ID NO: 13513 - RNA, 21 nt, Artificial Sequence
  Guide Sequence
uugugguuucaaaugcaucua

SEQ ID NO: 13514 - RNA, 21 nt, Artificial Sequence
  Guide Sequence
uuuaaucccagcacucuggaa

SEQ ID NO: 13515 - RNA, 21 nt, Artificial Sequence
  Guide Sequence
uuugaacccagaaggcggaga

SEQ ID NO: 13516 - RNA, 21 nt, Artificial Sequence
  Guide Sequence
uuugggaggcugaggcaggag

SEQ ID NO: 13517 - RNA, 21 nt, Artificial Sequence
  Guide Sequence
uuuguaacagcuaccuaacua

SEQ ID NO: 13518 - RNA, 21 nt, Artificial Sequence
  Guide Sequence
uuugugguuucaaaugcaucu

SEQ ID NO: 13519 - RNA, 22 nt, Artificial Sequence
  Guide Sequence
aaaaguuagucaagggggucuc

SEQ ID NO: 13520 - RNA, 22 nt, Artificial Sequence
  Guide Sequence
aaaccagaccaggcacaguggc

SEQ ID NO: 13521 - RNA, 22 nt, Artificial Sequence
  Guide Sequence
aaaguuagucaagggggucucu

SEQ ID NO: 13522 - RNA, 22 nt, Artificial Sequence
  Guide Sequence
aacaaucaagagacccaaacca

SEQ ID NO: 13523 - RNA, 22 nt, Artificial Sequence
  Guide Sequence
aacagcuaccuaacuacccacc

SEQ ID NO: 13524 - RNA, 22 nt, Artificial Sequence
  Guide Sequence
aaccagaccaggcacaguggcu

SEQ ID NO: 13525 - RNA, 22 nt, Artificial Sequence
  Guide Sequence
aacccagaaggcggagauugca

SEQ ID NO: 13526 - RNA, 22 nt, Artificial Sequence
  Guide Sequence
aacuacccaccacaggugggca

SEQ ID NO: 13527 - RNA, 22 nt, Artificial Sequence
  Guide Sequence
aagaacaaucaagagacccaaa

SEQ ID NO: 13528 - RNA, 22 nt, Artificial Sequence
  Guide Sequence
aagaauaaaaguuagucaaggg

SEQ ID NO: 13529 - RNA, 22 nt, Artificial Sequence
  Guide Sequence
aagagacccaaaccagaccagg

SEQ ID NO: 13530 - RNA, 22 nt, Artificial Sequence
  Guide Sequence
aagagacucaaaaaagagaccc

SEQ ID NO: 13531 - RNA, 22 nt, Artificial Sequence
  Guide Sequence
aagcgccucuuccucaugcccc

SEQ ID NO: 13532 - RNA, 22 nt, Artificial Sequence
  Guide Sequence
aaggcggagauugcagugagcu

SEQ ID NO: 13533 - RNA, 22 nt, Artificial Sequence
  Guide Sequence
aagggaagggaggaagcgccuc

SEQ ID NO: 13534 - RNA, 22 nt, Artificial Sequence
  Guide Sequence
aagggaggaagcgccucuuccu

SEQ ID NO: 13535 - RNA, 22 nt, Artificial Sequence
  Guide Sequence
aagggaguggccaggcacagug

SEQ ID NO: 13536 - RNA, 22 nt, Artificial Sequence
  Guide Sequence
aagggggucucugcuggggcac

SEQ ID NO: 13537 - RNA, 22 nt, Artificial Sequence
  Guide Sequence
aaguuagucaagggggucucug

SEQ ID NO: 13538 - RNA, 22 nt, Artificial Sequence
  Guide Sequence
aauaaaaguuagucaagggggu

SEQ ID NO: 13539 - RNA, 22 nt, Artificial Sequence
  Guide Sequence
aaucaagagacccaaaccagac

SEQ ID NO: 13540 - RNA, 22 nt, Artificial Sequence
  Guide Sequence
aaucacccugggcccccucacc

SEQ ID NO: 13541 - RNA, 22 nt, Artificial Sequence
  Guide Sequence
aaucauuugaacccagaaggcg

SEQ ID NO: 13542 - RNA, 22 nt, Artificial Sequence
  Guide Sequence
aaucccagcacucuggaaggcc

SEQ ID NO: 13543 - RNA, 22 nt, Artificial Sequence
  Guide Sequence
aaucccagcacuuugggaggcu

SEQ ID NO: 13544 - RNA, 22 nt, Artificial Sequence
  Guide Sequence
aauucucacuguggguauuccc

SEQ ID NO: 13545 - RNA, 22 nt, Artificial Sequence
  Guide Sequence
acaaucaagagacccaaaccag

SEQ ID NO: 13546 - RNA, 22 nt, Artificial Sequence
  Guide Sequence
acaccuuuaaucccagcacucu

SEQ ID NO: 13547 - RNA, 22 nt, Artificial Sequence
  Guide Sequence
acacuuguaaucccagcacuuu

SEQ ID NO: 13548 - RNA, 22 nt, Artificial Sequence
  Guide Sequence
acagagcaagagacucaaaaaa

SEQ ID NO: 13549 - RNA, 22 nt, Artificial Sequence
  Guide Sequence
acagcuaccuaacuacccacca

SEQ ID NO: 13550 - RNA, 22 nt, Artificial Sequence
  Guide Sequence
acaggugggcaccccgauuugu

SEQ ID NO: 13551 - RNA, 22 nt, Artificial Sequence
  Guide Sequence
acaguggcucacaccuuuaauc

SEQ ID NO: 13552 - RNA, 22 nt, Artificial Sequence
  Guide Sequence
acaguggcucacacuuguaauc

SEQ ID NO: 13553 - RNA, 22 nt, Artificial Sequence
  Guide Sequence
accacaggugggcaccccgauu

SEQ ID NO: 13554 - RNA, 22 nt, Artificial Sequence
  Guide Sequence
accagaccaggcacaguggcuc

SEQ ID NO: 13555 - RNA, 22 nt, Artificial Sequence
  Guide Sequence
accaggcacaguggcucacacu

SEQ ID NO: 13556 - RNA, 22 nt, Artificial Sequence
  Guide Sequence
acccaaaccagaccaggcacag

SEQ ID NO: 13557 - RNA, 22 nt, Artificial Sequence
  Guide Sequence
acccaagggaagggaggaagcg

SEQ ID NO: 13558 - RNA, 22 nt, Artificial Sequence
  Guide Sequence
acccaccacaggugggcacccc

SEQ ID NO: 13559 - RNA, 22 nt, Artificial Sequence
  Guide Sequence
acccagaaggcggagauugcag

SEQ ID NO: 13560 - RNA, 22 nt, Artificial Sequence
  Guide Sequence
accccgauuugugguuucaaau

SEQ ID NO: 13561 - RNA, 22 nt, Artificial Sequence
  Guide Sequence
acccugggcccccucacccaag

SEQ ID NO: 13562 - RNA, 22 nt, Artificial Sequence
  Guide Sequence
accuaacuacccaccacaggug

SEQ ID NO: 13563 - RNA, 22 nt, Artificial Sequence
  Guide Sequence
accuuuaaucccagcacucugg

SEQ ID NO: 13564 - RNA, 22 nt, Artificial Sequence
  Guide Sequence
acuacccaccacaggugggcac

SEQ ID NO: 13565 - RNA, 22 nt, Artificial Sequence
  Guide Sequence
acucaaaaaagagacccagacc

SEQ ID NO: 13566 - RNA, 22 nt, Artificial Sequence
  Guide Sequence
acuccagccugggcgacagagc

SEQ ID NO: 13567 - RNA, 22 nt, Artificial Sequence
  Guide Sequence
acucuggaaggccgaggcaggu

SEQ ID NO: 13568 - RNA, 22 nt, Artificial Sequence
  Guide Sequence
acugcacuccagccugggcgac

SEQ ID NO: 13569 - RNA, 22 nt, Artificial Sequence
  Guide Sequence
acuguggguauucccccauuuc

SEQ ID NO: 13570 - RNA, 22 nt, Artificial Sequence
  Guide Sequence
acuuguaaucccagcacuuugg

SEQ ID NO: 13571 - RNA, 22 nt, Artificial Sequence
  Guide Sequence
acuuugggaggcugaggcagga

SEQ ID NO: 13572 - RNA, 22 nt, Artificial Sequence
  Guide Sequence
acuuuguaacagcuaccuaacu

SEQ ID NO: 13573 - RNA, 22 nt, Artificial Sequence
  Guide Sequence
agaacaaucaagagacccaaac

SEQ ID NO: 13574 - RNA, 22 nt, Artificial Sequence
  Guide Sequence
agaaggcggagauugcagugag

SEQ ID NO: 13575 - RNA, 22 nt, Artificial Sequence
  Guide Sequence
agaauaaaaguuagucaagggg

SEQ ID NO: 13576 - RNA, 22 nt, Artificial Sequence
  Guide Sequence
agaaucauuugaacccagaagg

SEQ ID NO: 13577 - RNA, 22 nt, Artificial Sequence
  Guide Sequence
agaccaggcacaguggcucaca

SEQ ID NO: 13578 - RNA, 22 nt, Artificial Sequence
  Guide Sequence
agacccaaaccagaccaggcac

SEQ ID NO: 13579 - RNA, 22 nt, Artificial Sequence
  Guide Sequence
agacucaaaaaagagacccaga

SEQ ID NO: 13580 - RNA, 22 nt, Artificial Sequence
  Guide Sequence
agagacccaaaccagaccaggc

SEQ ID NO: 13581 - RNA, 22 nt, Artificial Sequence
  Guide Sequence
agagacucaaaaaagagaccca

SEQ ID NO: 13582 - RNA, 22 nt, Artificial Sequence
  Guide Sequence
agagcaagagacucaaaaaaga

SEQ ID NO: 13583 - RNA, 22 nt, Artificial Sequence
  Guide Sequence
agauggcgccacugcacuccag

SEQ ID NO: 13584 - RNA, 22 nt, Artificial Sequence
  Guide Sequence
agauugcagugagcugagaugg

SEQ ID NO: 13585 - RNA, 22 nt, Artificial Sequence
  Guide Sequence
agcaagagacucaaaaaagaga

SEQ ID NO: 13586 - RNA, 22 nt, Artificial Sequence
  Guide Sequence
agcacucuggaaggccgaggca

SEQ ID NO: 13587 - RNA, 22 nt, Artificial Sequence
  Guide Sequence
agcacuuugggaggcugaggca

SEQ ID NO: 13588 - RNA, 22 nt, Artificial Sequence
  Guide Sequence
agccugggcgacagagcaagag

SEQ ID NO: 13589 - RNA, 22 nt, Artificial Sequence
  Guide Sequence
agcgccucuuccucaugccccu

SEQ ID NO: 13590 - RNA, 22 nt, Artificial Sequence
  Guide Sequence
agcuaccuaacuacccaccaca

SEQ ID NO: 13591 - RNA, 22 nt, Artificial Sequence
  Guide Sequence
agcugagauggcgccacugcac

SEQ ID NO: 13592 - RNA, 22 nt, Artificial Sequence
  Guide Sequence
aggaagcgccucuuccucaugc

SEQ ID NO: 13593 - RNA, 22 nt, Artificial Sequence
  Guide Sequence
aggagaaucauuugaacccaga

SEQ ID NO: 13594 - RNA, 22 nt, Artificial Sequence
  Guide Sequence
aggcacaguggcucacaccuuu

SEQ ID NO: 13595 - RNA, 22 nt, Artificial Sequence
  Guide Sequence
aggcacaguggcucacacuugu

SEQ ID NO: 13596 - RNA, 22 nt, Artificial Sequence
  Guide Sequence
aggcaggagaaucauuugaacc

SEQ ID NO: 13597 - RNA, 22 nt, Artificial Sequence
  Guide Sequence
aggcggagauugcagugagcug

SEQ ID NO: 13598 - RNA, 22 nt, Artificial Sequence
  Guide Sequence
aggcugaggcaggagaaucauu

SEQ ID NO: 13599 - RNA, 22 nt, Artificial Sequence
  Guide Sequence
agggaagggaggaagcgccucu

SEQ ID NO: 13600 - RNA, 22 nt, Artificial Sequence
  Guide Sequence
agggaggaagcgccucuuccuc

SEQ ID NO: 13601 - RNA, 22 nt, Artificial Sequence
  Guide Sequence
agggaguggccaggcacagugg

SEQ ID NO: 13602 - RNA, 22 nt, Artificial Sequence
  Guide Sequence
agggggucucugcuggggcacu

SEQ ID NO: 13603 - RNA, 22 nt, Artificial Sequence
  Guide Sequence
aggugggcaccccgauuugugg

SEQ ID NO: 13604 - RNA, 22 nt, Artificial Sequence
  Guide Sequence
agucaagggggucucugcuggg

SEQ ID NO: 13605 - RNA, 22 nt, Artificial Sequence
  Guide Sequence
agucucaagggaguggccaggc

SEQ ID NO: 13606 - RNA, 22 nt, Artificial Sequence
  Guide Sequence
agugagcugagauggcgccacu

SEQ ID NO: 13607 - RNA, 22 nt, Artificial Sequence
  Guide Sequence
aguggccaggcacaguggcuca

SEQ ID NO: 13608 - RNA, 22 nt, Artificial Sequence
  Guide Sequence
aguggcucacaccuuuaauccc

SEQ ID NO: 13609 - RNA, 22 nt, Artificial Sequence
  Guide Sequence
aguggcucacacuuguaauccc

SEQ ID NO: 13610 - RNA, 22 nt, Artificial Sequence
  Guide Sequence
aguuagucaagggggucucugc

SEQ ID NO: 13611 - RNA, 22 nt, Artificial Sequence
  Guide Sequence
auaaaaguuagucaaggggguc

SEQ ID NO: 13612 - RNA, 22 nt, Artificial Sequence
  Guide Sequence
aucaagagacccaaaccagacc

SEQ ID NO: 13613 - RNA, 22 nt, Artificial Sequence
  Guide Sequence
aucacccugggcccccucaccc

SEQ ID NO: 13614 - RNA, 22 nt, Artificial Sequence
  Guide Sequence
aucauuugaacccagaaggcgg

SEQ ID NO: 13615 - RNA, 22 nt, Artificial Sequence
  Guide Sequence
aucccagcacucuggaaggccg

SEQ ID NO: 13616 - RNA, 22 nt, Artificial Sequence
  Guide Sequence
aucccagcacuuugggaggcug

SEQ ID NO: 13617 - RNA, 22 nt, Artificial Sequence
  Guide Sequence
aucuaauucucacuguggguau

SEQ ID NO: 13618 - RNA, 22 nt, Artificial Sequence
  Guide Sequence
aucuaucucaucuaauucucac

SEQ ID NO: 13619 - RNA, 22 nt, Artificial Sequence
  Guide Sequence
aucucaucuaauucucacugug

SEQ ID NO: 13620 - RNA, 22 nt, Artificial Sequence
  Guide Sequence
augcaucuaucucaucuaauuc

SEQ ID NO: 13621 - RNA, 22 nt, Artificial Sequence
  Guide Sequence
augccccugaagaacaaucaag

SEQ ID NO: 13622 - RNA, 22 nt, Artificial Sequence
  Guide Sequence
auggcgccacugcacuccagcc

SEQ ID NO: 13623 - RNA, 22 nt, Artificial Sequence
  Guide Sequence
auucccccauuucacagacgug

SEQ ID NO: 13624 - RNA, 22 nt, Artificial Sequence
  Guide Sequence
auucucacuguggguauucccc

SEQ ID NO: 13625 - RNA, 22 nt, Artificial Sequence
  Guide Sequence
auugcagugagcugagauggcg

SEQ ID NO: 13626 - RNA, 22 nt, Artificial Sequence
  Guide Sequence
auuugaacccagaaggcggaga

SEQ ID NO: 13627 - RNA, 22 nt, Artificial Sequence
  Guide Sequence
auuugugguuucaaaugcaucu

SEQ ID NO: 13628 - RNA, 22 nt, Artificial Sequence
  Guide Sequence
caaaccagaccaggcacagugg

SEQ ID NO: 13629 - RNA, 22 nt, Artificial Sequence
  Guide Sequence
caaaugcaucuaucucaucuaa

SEQ ID NO: 13630 - RNA, 22 nt, Artificial Sequence
  Guide Sequence
caagagacccaaaccagaccag

SEQ ID NO: 13631 - RNA, 22 nt, Artificial Sequence
  Guide Sequence
caagagacucaaaaaagagacc

SEQ ID NO: 13632 - RNA, 22 nt, Artificial Sequence
  Guide Sequence
caagggaagggaggaagcgccu

SEQ ID NO: 13633 - RNA, 22 nt, Artificial Sequence
  Guide Sequence
caagggaguggccaggcacagu

SEQ ID NO: 13634 - RNA, 22 nt, Artificial Sequence
  Guide Sequence
caagggggucucugcuggggca

SEQ ID NO: 13635 - RNA, 22 nt, Artificial Sequence
  Guide Sequence
caaucaagagacccaaaccaga

SEQ ID NO: 13636 - RNA, 22 nt, Artificial Sequence
  Guide Sequence
cacaccuuuaaucccagcacuc

SEQ ID NO: 13637 - RNA, 22 nt, Artificial Sequence
  Guide Sequence
cacacuuguaaucccagcacuu

SEQ ID NO: 13638 - RNA, 22 nt, Artificial Sequence
  Guide Sequence
cacaggugggcaccccgauuug

SEQ ID NO: 13639 - RNA, 22 nt, Artificial Sequence
  Guide Sequence
cacaguggcucacaccuuuaau

SEQ ID NO: 13640 - RNA, 22 nt, Artificial Sequence
  Guide Sequence
cacaguggcucacacuuguaau

SEQ ID NO: 13641 - RNA, 22 nt, Artificial Sequence
  Guide Sequence
caccacaggugggcaccccgau

SEQ ID NO: 13642 - RNA, 22 nt, Artificial Sequence
  Guide Sequence
cacccaagggaagggaggaagc

SEQ ID NO: 13643 - RNA, 22 nt, Artificial Sequence
  Guide Sequence
caccccgauuugugguuucaaa

SEQ ID NO: 13644 - RNA, 22 nt, Artificial Sequence
  Guide Sequence
cacccugggcccccucacccaa

SEQ ID NO: 13645 - RNA, 22 nt, Artificial Sequence
  Guide Sequence
caccuuuaaucccagcacucug

SEQ ID NO: 13646 - RNA, 22 nt, Artificial Sequence
  Guide Sequence
cacuccagccugggcgacagag

SEQ ID NO: 13647 - RNA, 22 nt, Artificial Sequence
  Guide Sequence
cacucuggaaggccgaggcagg

SEQ ID NO: 13648 - RNA, 22 nt, Artificial Sequence
  Guide Sequence
cacugcacuccagccugggcga

SEQ ID NO: 13649 - RNA, 22 nt, Artificial Sequence
  Guide Sequence
cacuguggguauucccccauuu

SEQ ID NO: 13650 - RNA, 22 nt, Artificial Sequence
  Guide Sequence
cacuuguaaucccagcacuuug

SEQ ID NO: 13651 - RNA, 22 nt, Artificial Sequence
  Guide Sequence
cacuuugggaggcugaggcagg

SEQ ID NO: 13652 - RNA, 22 nt, Artificial Sequence
  Guide Sequence
cacuuuguaacagcuaccuaac

SEQ ID NO: 13653 - RNA, 22 nt, Artificial Sequence
  Guide Sequence
cagaaggcggagauugcaguga

SEQ ID NO: 13654 - RNA, 22 nt, Artificial Sequence
  Guide Sequence
cagaccaggcacaguggcucac

SEQ ID NO: 13655 - RNA, 22 nt, Artificial Sequence
  Guide Sequence
cagagcaagagacucaaaaaag

SEQ ID NO: 13656 - RNA, 22 nt, Artificial Sequence
  Guide Sequence
cagcacucuggaaggccgaggc

SEQ ID NO: 13657 - RNA, 22 nt, Artificial Sequence
  Guide Sequence
cagcacuuugggaggcugaggc

SEQ ID NO: 13658 - RNA, 22 nt, Artificial Sequence
  Guide Sequence
cagccugggcgacagagcaaga

SEQ ID NO: 13659 - RNA, 22 nt, Artificial Sequence
  Guide Sequence
cagcuaccuaacuacccaccac

SEQ ID NO: 13660 - RNA, 22 nt, Artificial Sequence
  Guide Sequence
caggagaaucauuugaacccag

SEQ ID NO: 13661 - RNA, 22 nt, Artificial Sequence
  Guide Sequence
caggcacaguggcucacaccuu

SEQ ID NO: 13662 - RNA, 22 nt, Artificial Sequence
  Guide Sequence
caggcacaguggcucacacuug

SEQ ID NO: 13663 - RNA, 22 nt, Artificial Sequence
  Guide Sequence
caggugggcaccccgauuugug

SEQ ID NO: 13664 - RNA, 22 nt, Artificial Sequence
  Guide Sequence
cagugagcugagauggcgccac

SEQ ID NO: 13665 - RNA, 22 nt, Artificial Sequence
  Guide Sequence
caguggcucacaccuuuaaucc

SEQ ID NO: 13666 - RNA, 22 nt, Artificial Sequence
  Guide Sequence
caguggcucacacuuguaaucc

SEQ ID NO: 13667 - RNA, 22 nt, Artificial Sequence
  Guide Sequence
caucuaauucucacugugggua

SEQ ID NO: 13668 - RNA, 22 nt, Artificial Sequence
  Guide Sequence
caucuaucucaucuaauucuca

SEQ ID NO: 13669 - RNA, 22 nt, Artificial Sequence
  Guide Sequence
caugccccugaagaacaaucaa

SEQ ID NO: 13670 - RNA, 22 nt, Artificial Sequence
  Guide Sequence
cauuugaacccagaaggcggag

SEQ ID NO: 13671 - RNA, 22 nt, Artificial Sequence
  Guide Sequence
ccaaaccagaccaggcacagug

SEQ ID NO: 13672 - RNA, 22 nt, Artificial Sequence
  Guide Sequence
ccaagggaagggaggaagcgcc

SEQ ID NO: 13673 - RNA, 22 nt, Artificial Sequence
  Guide Sequence
ccacaggugggcaccccgauuu

SEQ ID NO: 13674 - RNA, 22 nt, Artificial Sequence
  Guide Sequence
ccaccacaggugggcaccccga

SEQ ID NO: 13675 - RNA, 22 nt, Artificial Sequence
  Guide Sequence
ccacugcacuccagccugggcg

SEQ ID NO: 13676 - RNA, 22 nt, Artificial Sequence
  Guide Sequence
ccagaaggcggagauugcagug

SEQ ID NO: 13677 - RNA, 22 nt, Artificial Sequence
  Guide Sequence
ccagaccaggcacaguggcuca

SEQ ID NO: 13678 - RNA, 22 nt, Artificial Sequence
  Guide Sequence
ccagcacucuggaaggccgagg

SEQ ID NO: 13679 - RNA, 22 nt, Artificial Sequence
  Guide Sequence
ccagcacuuugggaggcugagg

SEQ ID NO: 13680 - RNA, 22 nt, Artificial Sequence
  Guide Sequence
ccagccugggcgacagagcaag

SEQ ID NO: 13681 - RNA, 22 nt, Artificial Sequence
  Guide Sequence
ccaggcacaguggcucacaccu

SEQ ID NO: 13682 - RNA, 22 nt, Artificial Sequence
  Guide Sequence
ccaggcacaguggcucacacuu

SEQ ID NO: 13683 - RNA, 22 nt, Artificial Sequence
  Guide Sequence
cccaaaccagaccaggcacagu

SEQ ID NO: 13684 - RNA, 22 nt, Artificial Sequence
  Guide Sequence
cccaagggaagggaggaagcgc

SEQ ID NO: 13685 - RNA, 22 nt, Artificial Sequence
  Guide Sequence
cccaccacaggugggcaccccg

SEQ ID NO: 13686 - RNA, 22 nt, Artificial Sequence
  Guide Sequence
cccagaaggcggagauugcagu

SEQ ID NO: 13687 - RNA, 22 nt, Artificial Sequence
  Guide Sequence
cccagcacucuggaaggccgag

SEQ ID NO: 13688 - RNA, 22 nt, Artificial Sequence
  Guide Sequence
cccagcacuuugggaggcugag

SEQ ID NO: 13689 - RNA, 22 nt, Artificial Sequence
  Guide Sequence
cccccauuucacagacguggaa

SEQ ID NO: 13690 - RNA, 22 nt, Artificial Sequence
  Guide Sequence
cccccucacccaagggaaggga

SEQ ID NO: 13691 - RNA, 22 nt, Artificial Sequence
  Guide Sequence
ccccgauuugugguuucaaaug

SEQ ID NO: 13692 - RNA, 22 nt, Artificial Sequence
  Guide Sequence
ccccucacccaagggaagggag

SEQ ID NO: 13693 - RNA, 22 nt, Artificial Sequence
  Guide Sequence
ccccugaagaacaaucaagaga

SEQ ID NO: 13694 - RNA, 22 nt, Artificial Sequence
  Guide Sequence
cccgauuugugguuucaaaugc

SEQ ID NO: 13695 - RNA, 22 nt, Artificial Sequence
  Guide Sequence
cccucacccaagggaagggagg

SEQ ID NO: 13696 - RNA, 22 nt, Artificial Sequence
  Guide Sequence
cccugaagaacaaucaagagac

SEQ ID NO: 13697 - RNA, 22 nt, Artificial Sequence
  Guide Sequence
cccugggcccccucacccaagg

SEQ ID NO: 13698 - RNA, 22 nt, Artificial Sequence
  Guide Sequence
ccgauuugugguuucaaaugca

SEQ ID NO: 13699 - RNA, 22 nt, Artificial Sequence
  Guide Sequence
ccuaacuacccaccacaggugg

SEQ ID NO: 13700 - RNA, 22 nt, Artificial Sequence
  Guide Sequence
ccucacccaagggaagggagga

SEQ ID NO: 13701 - RNA, 22 nt, Artificial Sequence
  Guide Sequence
ccucaugccccugaagaacaau

SEQ ID NO: 13702 - RNA, 22 nt, Artificial Sequence
  Guide Sequence
ccucuuccucaugccccugaag

SEQ ID NO: 13703 - RNA, 22 nt, Artificial Sequence
  Guide Sequence
ccugaagaacaaucaagagacc

SEQ ID NO: 13704 - RNA, 22 nt, Artificial Sequence
  Guide Sequence
ccugggcccccucacccaaggg

SEQ ID NO: 13705 - RNA, 22 nt, Artificial Sequence
  Guide Sequence
ccugggcgacagagcaagagac

SEQ ID NO: 13706 - RNA, 22 nt, Artificial Sequence
  Guide Sequence
ccuuuaaucccagcacucugga

SEQ ID NO: 13707 - RNA, 22 nt, Artificial Sequence
  Guide Sequence
cgacagagcaagagacucaaaa

SEQ ID NO: 13708 - RNA, 22 nt, Artificial Sequence
  Guide Sequence
cgauuugugguuucaaaugcau

SEQ ID NO: 13709 - RNA, 22 nt, Artificial Sequence
  Guide Sequence
cgccacugcacuccagccuggg

SEQ ID NO: 13710 - RNA, 22 nt, Artificial Sequence
  Guide Sequence
cgccucuuccucaugccccuga

SEQ ID NO: 13711 - RNA, 22 nt, Artificial Sequence
  Guide Sequence
cggagauugcagugagcugaga

SEQ ID NO: 13712 - RNA, 22 nt, Artificial Sequence
  Guide Sequence
cuaacuacccaccacagguggg

SEQ ID NO: 13713 - RNA, 22 nt, Artificial Sequence
  Guide Sequence
cuaauucucacuguggguauuc

SEQ ID NO: 13714 - RNA, 22 nt, Artificial Sequence
  Guide Sequence
cuacccaccacaggugggcacc

SEQ ID NO: 13715 - RNA, 22 nt, Artificial Sequence
  Guide Sequence
cuaccuaacuacccaccacagg

SEQ ID NO: 13716 - RNA, 22 nt, Artificial Sequence
  Guide Sequence
cuaucucaucuaauucucacug

SEQ ID NO: 13717 - RNA, 22 nt, Artificial Sequence
  Guide Sequence
cucaagggaguggccaggcaca

SEQ ID NO: 13718 - RNA, 22 nt, Artificial Sequence
  Guide Sequence
cucacaccuuuaaucccagcac

SEQ ID NO: 13719 - RNA, 22 nt, Artificial Sequence
  Guide Sequence
cucacacuuguaaucccagcac

SEQ ID NO: 13720 - RNA, 22 nt, Artificial Sequence
  Guide Sequence
cucacccaagggaagggaggaa

SEQ ID NO: 13721 - RNA, 22 nt, Artificial Sequence
  Guide Sequence
cucacuguggguauucccccau

SEQ ID NO: 13722 - RNA, 22 nt, Artificial Sequence
  Guide Sequence
cucaucuaauucucacuguggg

SEQ ID NO: 13723 - RNA, 22 nt, Artificial Sequence
  Guide Sequence
cucaugccccugaagaacaauc

SEQ ID NO: 13724 - RNA, 22 nt, Artificial Sequence
  Guide Sequence
cuccagccugggcgacagagca

SEQ ID NO: 13725 - RNA, 22 nt, Artificial Sequence
  Guide Sequence
cucugcuggggcacuuuguaac

SEQ ID NO: 13726 - RNA, 22 nt, Artificial Sequence
  Guide Sequence
cucuggaaggccgaggcaggug

SEQ ID NO: 13727 - RNA, 22 nt, Artificial Sequence
  Guide Sequence
cucuuccucaugccccugaaga

SEQ ID NO: 13728 - RNA, 22 nt, Artificial Sequence
  Guide Sequence
cugaagaacaaucaagagaccc

SEQ ID NO: 13729 - RNA, 22 nt, Artificial Sequence
  Guide Sequence
cugagauggcgccacugcacuc

SEQ ID NO: 13730 - RNA, 22 nt, Artificial Sequence
  Guide Sequence
cugaggcaggagaaucauuuga

SEQ ID NO: 13731 - RNA, 22 nt, Artificial Sequence
  Guide Sequence
cugcacuccagccugggcgaca

SEQ ID NO: 13732 - RNA, 22 nt, Artificial Sequence
  Guide Sequence
cugcuggggcacuuuguaacag

SEQ ID NO: 13733 - RNA, 22 nt, Artificial Sequence
  Guide Sequence
cugggcccccucacccaaggga

SEQ ID NO: 13734 - RNA, 22 nt, Artificial Sequence
  Guide Sequence
cugggcgacagagcaagagacu

SEQ ID NO: 13735 - RNA, 22 nt, Artificial Sequence
  Guide Sequence
cuggggcacuuuguaacagcua

SEQ ID NO: 13736 - RNA, 22 nt, Artificial Sequence
  Guide Sequence
cugugggaaaagauggaagaau

SEQ ID NO: 13737 - RNA, 22 nt, Artificial Sequence
  Guide Sequence
cuguggguauucccccauuuca

SEQ ID NO: 13738 - RNA, 22 nt, Artificial Sequence
  Guide Sequence
cuuccucaugccccugaagaac

SEQ ID NO: 13739 - RNA, 22 nt, Artificial Sequence
  Guide Sequence
cuuguaaucccagcacuuuggg

SEQ ID NO: 13740 - RNA, 22 nt, Artificial Sequence
  Guide Sequence
cuuuaaucccagcacucuggaa

SEQ ID NO: 13741 - RNA, 22 nt, Artificial Sequence
  Guide Sequence
cuuugggaggcugaggcaggag

SEQ ID NO: 13742 - RNA, 22 nt, Artificial Sequence
  Guide Sequence
cuuuguaacagcuaccuaacua

SEQ ID NO: 13743 - RNA, 22 nt, Artificial Sequence
  Guide Sequence
gaacaaucaagagacccaaacc

SEQ ID NO: 13744 - RNA, 22 nt, Artificial Sequence
  Guide Sequence
gaacccagaaggcggagauugc

SEQ ID NO: 13745 - RNA, 22 nt, Artificial Sequence
  Guide Sequence
gaagaacaaucaagagacccaa

SEQ ID NO: 13746 - RNA, 22 nt, Artificial Sequence
  Guide Sequence
gaagaauaaaaguuagucaagg

SEQ ID NO: 13747 - RNA, 22 nt, Artificial Sequence
  Guide Sequence
gaagcgccucuuccucaugccc

SEQ ID NO: 13748 - RNA, 22 nt, Artificial Sequence
  Guide Sequence
gaaggcggagauugcagugagc

SEQ ID NO: 13749 - RNA, 22 nt, Artificial Sequence
  Guide Sequence
gaagggaggaagcgccucuucc

SEQ ID NO: 13750 - RNA, 22 nt, Artificial Sequence
  Guide Sequence
gaauaaaaguuagucaaggggg

SEQ ID NO: 13751 - RNA, 22 nt, Artificial Sequence
  Guide Sequence
gaaucauuugaacccagaaggc

SEQ ID NO: 13752 - RNA, 22 nt, Artificial Sequence
  Guide Sequence
gacagagcaagagacucaaaaa

SEQ ID NO: 13753 - RNA, 22 nt, Artificial Sequence
  Guide Sequence
gaccaggcacaguggcucacac

SEQ ID NO: 13754 - RNA, 22 nt, Artificial Sequence
  Guide Sequence
gacccaaaccagaccaggcaca

SEQ ID NO: 13755 - RNA, 22 nt, Artificial Sequence
  Guide Sequence
gacucaaaaaagagacccagac

SEQ ID NO: 13756 - RNA, 22 nt, Artificial Sequence
  Guide Sequence
gagaaucauuugaacccagaag

SEQ ID NO: 13757 - RNA, 22 nt, Artificial Sequence
  Guide Sequence
gagacccaaaccagaccaggca

SEQ ID NO: 13758 - RNA, 22 nt, Artificial Sequence
  Guide Sequence
gagacucaaaaaagagacccag

SEQ ID NO: 13759 - RNA, 22 nt, Artificial Sequence
  Guide Sequence
gagauggcgccacugcacucca

SEQ ID NO: 13760 - RNA, 22 nt, Artificial Sequence
  Guide Sequence
gagauugcagugagcugagaug

SEQ ID NO: 13761 - RNA, 22 nt, Artificial Sequence
  Guide Sequence
gagcaagagacucaaaaaagag

SEQ ID NO: 13762 - RNA, 22 nt, Artificial Sequence
  Guide Sequence
gagcugagauggcgccacugca

SEQ ID NO: 13763 - RNA, 22 nt, Artificial Sequence
  Guide Sequence
gaggaagcgccucuuccucaug

SEQ ID NO: 13764 - RNA, 22 nt, Artificial Sequence
  Guide Sequence
gaggcaggagaaucauuugaac

SEQ ID NO: 13765 - RNA, 22 nt, Artificial Sequence
  Guide Sequence
gaggcugaggcaggagaaucau

SEQ ID NO: 13766 - RNA, 22 nt, Artificial Sequence
  Guide Sequence
gaguggccaggcacaguggcuc

SEQ ID NO: 13767 - RNA, 22 nt, Artificial Sequence
  Guide Sequence
gauggaagaauaaaaguuaguc

SEQ ID NO: 13768 - RNA, 22 nt, Artificial Sequence
  Guide Sequence
gauggcgccacugcacuccagc

SEQ ID NO: 13769 - RNA, 22 nt, Artificial Sequence
  Guide Sequence
gauugcagugagcugagauggc

SEQ ID NO: 13770 - RNA, 22 nt, Artificial Sequence
  Guide Sequence
gauuugugguuucaaaugcauc

SEQ ID NO: 13771 - RNA, 22 nt, Artificial Sequence
  Guide Sequence
gcaagagacucaaaaaagagac

SEQ ID NO: 13772 - RNA, 22 nt, Artificial Sequence
  Guide Sequence
gcacaguggcucacaccuuuaa

SEQ ID NO: 13773 - RNA, 22 nt, Artificial Sequence
  Guide Sequence
gcacaguggcucacacuuguaa

SEQ ID NO: 13774 - RNA, 22 nt, Artificial Sequence
  Guide Sequence
gcaccccgauuugugguuucaa

SEQ ID NO: 13775 - RNA, 22 nt, Artificial Sequence
  Guide Sequence
gcacuccagccugggcgacaga

SEQ ID NO: 13776 - RNA, 22 nt, Artificial Sequence
  Guide Sequence
gcacucuggaaggccgaggcag

SEQ ID NO: 13777 - RNA, 22 nt, Artificial Sequence
  Guide Sequence
gcacuuugggaggcugaggcag

SEQ ID NO: 13778 - RNA, 22 nt, Artificial Sequence
  Guide Sequence
gcacuuuguaacagcuaccuaa

SEQ ID NO: 13779 - RNA, 22 nt, Artificial Sequence
  Guide Sequence
gcaggagaaucauuugaaccca

SEQ ID NO: 13780 - RNA, 22 nt, Artificial Sequence
  Guide Sequence
gcagugagcugagauggcgcca

SEQ ID NO: 13781 - RNA, 22 nt, Artificial Sequence
  Guide Sequence
gcaucuaucucaucuaauucuc

SEQ ID NO: 13782 - RNA, 22 nt, Artificial Sequence
  Guide Sequence
gccacugcacuccagccugggc

SEQ ID NO: 13783 - RNA, 22 nt, Artificial Sequence
  Guide Sequence
gccaggcacaguggcucacacc

SEQ ID NO: 13784 - RNA, 22 nt, Artificial Sequence
  Guide Sequence
gcccccucacccaagggaaggg

SEQ ID NO: 13785 - RNA, 22 nt, Artificial Sequence
  Guide Sequence
gccccugaagaacaaucaagag

SEQ ID NO: 13786 - RNA, 22 nt, Artificial Sequence
  Guide Sequence
gccucuuccucaugccccugaa

SEQ ID NO: 13787 - RNA, 22 nt, Artificial Sequence
  Guide Sequence
gccugggcgacagagcaagaga

SEQ ID NO: 13788 - RNA, 22 nt, Artificial Sequence
  Guide Sequence
gcgacagagcaagagacucaaa

SEQ ID NO: 13789 - RNA, 22 nt, Artificial Sequence
  Guide Sequence
gcgccacugcacuccagccugg

SEQ ID NO: 13790 - RNA, 22 nt, Artificial Sequence
  Guide Sequence
gcgccucuuccucaugccccug

SEQ ID NO: 13791 - RNA, 22 nt, Artificial Sequence
  Guide Sequence
gcggagauugcagugagcugag

SEQ ID NO: 13792 - RNA, 22 nt, Artificial Sequence
  Guide Sequence
gcuaccuaacuacccaccacag

SEQ ID NO: 13793 - RNA, 22 nt, Artificial Sequence
  Guide Sequence
gcucacaccuuuaaucccagca

SEQ ID NO: 13794 - RNA, 22 nt, Artificial Sequence
  Guide Sequence
gcucacacuuguaaucccagca

SEQ ID NO: 13795 - RNA, 22 nt, Artificial Sequence
  Guide Sequence
gcugagauggcgccacugcacu

SEQ ID NO: 13796 - RNA, 22 nt, Artificial Sequence
  Guide Sequence
gcugaggcaggagaaucauuug

SEQ ID NO: 13797 - RNA, 22 nt, Artificial Sequence
  Guide Sequence
gcuggggcacuuuguaacagcu

SEQ ID NO: 13798 - RNA, 22 nt, Artificial Sequence
  Guide Sequence
ggaaaagauggaagaauaaaag

SEQ ID NO: 13799 - RNA, 22 nt, Artificial Sequence
  Guide Sequence
ggaagaauaaaaguuagucaag

SEQ ID NO: 13800 - RNA, 22 nt, Artificial Sequence
  Guide Sequence
ggaagcgccucuuccucaugcc

SEQ ID NO: 13801 - RNA, 22 nt, Artificial Sequence
  Guide Sequence
ggaagggaggaagcgccucuuc

SEQ ID NO: 13802 - RNA, 22 nt, Artificial Sequence
  Guide Sequence
ggagaaucauuugaacccagaa

SEQ ID NO: 13803 - RNA, 22 nt, Artificial Sequence
  Guide Sequence
ggagauugcagugagcugagau

SEQ ID NO: 13804 - RNA, 22 nt, Artificial Sequence
  Guide Sequence
ggaggaagcgccucuuccucau

SEQ ID NO: 13805 - RNA, 22 nt, Artificial Sequence
  Guide Sequence
ggaggcugaggcaggagaauca

SEQ ID NO: 13806 - RNA, 22 nt, Artificial Sequence
  Guide Sequence
ggaguggccaggcacaguggcu

SEQ ID NO: 13807 - RNA, 22 nt, Artificial Sequence
  Guide Sequence
ggcacaguggcucacaccuuua

SEQ ID NO: 13808 - RNA, 22 nt, Artificial Sequence
  Guide Sequence
ggcacaguggcucacacuugua

SEQ ID NO: 13809 - RNA, 22 nt, Artificial Sequence
  Guide Sequence
ggcaccccgauuugugguuuca

SEQ ID NO: 13810 - RNA, 22 nt, Artificial Sequence
  Guide Sequence
ggcacuuuguaacagcuaccua

SEQ ID NO: 13811 - RNA, 22 nt, Artificial Sequence
  Guide Sequence
ggcaggagaaucauuugaaccc

SEQ ID NO: 13812 - RNA, 22 nt, Artificial Sequence
  Guide Sequence
ggccaggcacaguggcucacac

SEQ ID NO: 13813 - RNA, 22 nt, Artificial Sequence
  Guide Sequence
ggcccccucacccaagggaagg

SEQ ID NO: 13814 - RNA, 22 nt, Artificial Sequence
  Guide Sequence
ggcgacagagcaagagacucaa

SEQ ID NO: 13815 - RNA, 22 nt, Artificial Sequence
  Guide Sequence
ggcgccacugcacuccagccug

SEQ ID NO: 13816 - RNA, 22 nt, Artificial Sequence
  Guide Sequence
ggcggagauugcagugagcuga

SEQ ID NO: 13817 - RNA, 22 nt, Artificial Sequence
  Guide Sequence
ggcucacaccuuuaaucccagc

SEQ ID NO: 13818 - RNA, 22 nt, Artificial Sequence
  Guide Sequence
ggcucacacuuguaaucccagc

SEQ ID NO: 13819 - RNA, 22 nt, Artificial Sequence
  Guide Sequence
ggcugaggcaggagaaucauuu

SEQ ID NO: 13820 - RNA, 22 nt, Artificial Sequence
  Guide Sequence
gggaaaagauggaagaauaaaa

SEQ ID NO: 13821 - RNA, 22 nt, Artificial Sequence
  Guide Sequence
gggaagggaggaagcgccucuu

SEQ ID NO: 13822 - RNA, 22 nt, Artificial Sequence
  Guide Sequence
gggaggaagcgccucuuccuca

SEQ ID NO: 13823 - RNA, 22 nt, Artificial Sequence
  Guide Sequence
gggaggcugaggcaggagaauc

SEQ ID NO: 13824 - RNA, 22 nt, Artificial Sequence
  Guide Sequence
gggaguggccaggcacaguggc

SEQ ID NO: 13825 - RNA, 22 nt, Artificial Sequence
  Guide Sequence
gggcaccccgauuugugguuuc

SEQ ID NO: 13826 - RNA, 22 nt, Artificial Sequence
  Guide Sequence
gggcacuuuguaacagcuaccu

SEQ ID NO: 13827 - RNA, 22 nt, Artificial Sequence
  Guide Sequence
gggcccccucacccaagggaag

SEQ ID NO: 13828 - RNA, 22 nt, Artificial Sequence
  Guide Sequence
gggcgacagagcaagagacuca

SEQ ID NO: 13829 - RNA, 22 nt, Artificial Sequence
  Guide Sequence
ggggcacuuuguaacagcuacc

SEQ ID NO: 13830 - RNA, 22 nt, Artificial Sequence
  Guide Sequence
gggggucucugcuggggcacuu

SEQ ID NO: 13831 - RNA, 22 nt, Artificial Sequence
  Guide Sequence
ggggucucugcuggggcacuuu

SEQ ID NO: 13832 - RNA, 22 nt, Artificial Sequence
  Guide Sequence
ggguauucccccauuucacaga

SEQ ID NO: 13833 - RNA, 22 nt, Artificial Sequence
  Guide Sequence
gggucucugcuggggcacuuug

SEQ ID NO: 13834 - RNA, 22 nt, Artificial Sequence
  Guide Sequence
gguauucccccauuucacagac

SEQ ID NO: 13835 - RNA, 22 nt, Artificial Sequence
  Guide Sequence
ggucucugcuggggcacuuugu

SEQ ID NO: 13836 - RNA, 22 nt, Artificial Sequence
  Guide Sequence
ggugggcaccccgauuuguggu

SEQ ID NO: 13837 - RNA, 22 nt, Artificial Sequence
  Guide Sequence
gguuucaaaugcaucuaucuca

SEQ ID NO: 13838 - RNA, 22 nt, Artificial Sequence
  Guide Sequence
guaacagcuaccuaacuaccca

SEQ ID NO: 13839 - RNA, 22 nt, Artificial Sequence
  Guide Sequence
guaaucccagcacuuugggagg

SEQ ID NO: 13840 - RNA, 22 nt, Artificial Sequence
  Guide Sequence
guauucccccauuucacagacg

SEQ ID NO: 13841 - RNA, 22 nt, Artificial Sequence
  Guide Sequence
gucaagggggucucugcugggg

SEQ ID NO: 13842 - RNA, 22 nt, Artificial Sequence
  Guide Sequence
gucucaagggaguggccaggca

SEQ ID NO: 13843 - RNA, 22 nt, Artificial Sequence
  Guide Sequence
gucucugcuggggcacuuugua

SEQ ID NO: 13844 - RNA, 22 nt, Artificial Sequence
  Guide Sequence
gugagcugagauggcgccacug

SEQ ID NO: 13845 - RNA, 22 nt, Artificial Sequence
  Guide Sequence
guggccaggcacaguggcucac

SEQ ID NO: 13846 - RNA, 22 nt, Artificial Sequence
  Guide Sequence
guggcucacaccuuuaauccca

SEQ ID NO: 13847 - RNA, 22 nt, Artificial Sequence
  Guide Sequence
guggcucacacuuguaauccca

SEQ ID NO: 13848 - RNA, 22 nt, Artificial Sequence
  Guide Sequence
gugggaaaagauggaagaauaa

SEQ ID NO: 13849 - RNA, 22 nt, Artificial Sequence
  Guide Sequence
gugggcaccccgauuugugguu

SEQ ID NO: 13850 - RNA, 22 nt, Artificial Sequence
  Guide Sequence
guggguauucccccauuucaca

SEQ ID NO: 13851 - RNA, 22 nt, Artificial Sequence
  Guide Sequence
gugguuucaaaugcaucuaucu

SEQ ID NO: 13852 - RNA, 22 nt, Artificial Sequence
  Guide Sequence
guuagucaagggggucucugcu

SEQ ID NO: 13853 - RNA, 22 nt, Artificial Sequence
  Guide Sequence
guuucaaaugcaucuaucucau

SEQ ID NO: 13854 - RNA, 22 nt, Artificial Sequence
  Guide Sequence
uaaaaguuagucaagggggucu

SEQ ID NO: 13855 - RNA, 22 nt, Artificial Sequence
  Guide Sequence
uaacagcuaccuaacuacccac

SEQ ID NO: 13856 - RNA, 22 nt, Artificial Sequence
  Guide Sequence
uaacuacccaccacaggugggc

SEQ ID NO: 13857 - RNA, 22 nt, Artificial Sequence
  Guide Sequence
uaaucccagcacucuggaaggc

SEQ ID NO: 13858 - RNA, 22 nt, Artificial Sequence
  Guide Sequence
uaaucccagcacuuugggaggc

SEQ ID NO: 13859 - RNA, 22 nt, Artificial Sequence
  Guide Sequence
uaauucucacuguggguauucc

SEQ ID NO: 13860 - RNA, 22 nt, Artificial Sequence
  Guide Sequence
uacccaccacaggugggcaccc

SEQ ID NO: 13861 - RNA, 22 nt, Artificial Sequence
  Guide Sequence
uaccuaacuacccaccacaggu

SEQ ID NO: 13862 - RNA, 22 nt, Artificial Sequence
  Guide Sequence
uagucaagggggucucugcugg

SEQ ID NO: 13863 - RNA, 22 nt, Artificial Sequence
  Guide Sequence
uaucucaucuaauucucacugu

SEQ ID NO: 13864 - RNA, 22 nt, Artificial Sequence
  Guide Sequence
uauucccccauuucacagacgu

SEQ ID NO: 13865 - RNA, 22 nt, Artificial Sequence
  Guide Sequence
ucaaaugcaucuaucucaucua

SEQ ID NO: 13866 - RNA, 22 nt, Artificial Sequence
  Guide Sequence
ucaagagacccaaaccagacca

SEQ ID NO: 13867 - RNA, 22 nt, Artificial Sequence
  Guide Sequence
ucaagggaguggccaggcacag

SEQ ID NO: 13868 - RNA, 22 nt, Artificial Sequence
  Guide Sequence
ucaagggggucucugcuggggc

SEQ ID NO: 13869 - RNA, 22 nt, Artificial Sequence
  Guide Sequence
ucacaccuuuaaucccagcacu

SEQ ID NO: 13870 - RNA, 22 nt, Artificial Sequence
  Guide Sequence
ucacacuuguaaucccagcacu

SEQ ID NO: 13871 - RNA, 22 nt, Artificial Sequence
  Guide Sequence
ucacccaagggaagggaggaag

SEQ ID NO: 13872 - RNA, 22 nt, Artificial Sequence
  Guide Sequence
ucacccugggcccccucaccca

SEQ ID NO: 13873 - RNA, 22 nt, Artificial Sequence
  Guide Sequence
ucacuguggguauucccccauu

SEQ ID NO: 13874 - RNA, 22 nt, Artificial Sequence
  Guide Sequence
ucaucuaauucucacugugggu

SEQ ID NO: 13875 - RNA, 22 nt, Artificial Sequence
  Guide Sequence
ucaugccccugaagaacaauca

SEQ ID NO: 13876 - RNA, 22 nt, Artificial Sequence
  Guide Sequence
ucauuugaacccagaaggcgga

SEQ ID NO: 13877 - RNA, 22 nt, Artificial Sequence
  Guide Sequence
uccagccugggcgacagagcaa

SEQ ID NO: 13878 - RNA, 22 nt, Artificial Sequence
  Guide Sequence
ucccagcacucuggaaggccga

SEQ ID NO: 13879 - RNA, 22 nt, Artificial Sequence
  Guide Sequence
ucccagcacuuugggaggcuga

SEQ ID NO: 13880 - RNA, 22 nt, Artificial Sequence
  Guide Sequence
ucccccauuucacagacgugga

SEQ ID NO: 13881 - RNA, 22 nt, Artificial Sequence
  Guide Sequence
uccucaugccccugaagaacaa

SEQ ID NO: 13882 - RNA, 22 nt, Artificial Sequence
  Guide Sequence
ucuaauucucacuguggguauu

SEQ ID NO: 13883 - RNA, 22 nt, Artificial Sequence
  Guide Sequence
ucuaucucaucuaauucucacu

SEQ ID NO: 13884 - RNA, 22 nt, Artificial Sequence
  Guide Sequence
ucucaagggaguggccaggcac

SEQ ID NO: 13885 - RNA, 22 nt, Artificial Sequence
  Guide Sequence
ucucacuguggguauuccccca

SEQ ID NO: 13886 - RNA, 22 nt, Artificial Sequence
  Guide Sequence
ucucaucuaauucucacugugg

SEQ ID NO: 13887 - RNA, 22 nt, Artificial Sequence
  Guide Sequence
ucucugcuggggcacuuuguaa

SEQ ID NO: 13888 - RNA, 22 nt, Artificial Sequence
  Guide Sequence
ucugcuggggcacuuuguaaca

SEQ ID NO: 13889 - RNA, 22 nt, Artificial Sequence
  Guide Sequence
ucuuccucaugccccugaagaa

SEQ ID NO: 13890 - RNA, 22 nt, Artificial Sequence
  Guide Sequence
ugaacccagaaggcggagauug

SEQ ID NO: 13891 - RNA, 22 nt, Artificial Sequence
  Guide Sequence
ugaagaacaaucaagagaccca

SEQ ID NO: 13892 - RNA, 22 nt, Artificial Sequence
  Guide Sequence
ugagauggcgccacugcacucc

SEQ ID NO: 13893 - RNA, 22 nt, Artificial Sequence
  Guide Sequence
ugagcugagauggcgccacugc

SEQ ID NO: 13894 - RNA, 22 nt, Artificial Sequence
  Guide Sequence
ugaggcaggagaaucauuugaa

SEQ ID NO: 13895 - RNA, 22 nt, Artificial Sequence
  Guide Sequence
ugcacuccagccugggcgacag

SEQ ID NO: 13896 - RNA, 22 nt, Artificial Sequence
  Guide Sequence
ugcagugagcugagauggcgcc

SEQ ID NO: 13897 - RNA, 22 nt, Artificial Sequence
  Guide Sequence
ugcaucuaucucaucuaauucu

SEQ ID NO: 13898 - RNA, 22 nt, Artificial Sequence
  Guide Sequence
ugccccugaagaacaaucaaga

SEQ ID NO: 13899 - RNA, 22 nt, Artificial Sequence
  Guide Sequence
ugcuggggcacuuuguaacagc

SEQ ID NO: 13900 - RNA, 22 nt, Artificial Sequence
  Guide Sequence
uggccaggcacaguggcucaca

SEQ ID NO: 13901 - RNA, 22 nt, Artificial Sequence
  Guide Sequence
uggcgccacugcacuccagccu

SEQ ID NO: 13902 - RNA, 22 nt, Artificial Sequence
  Guide Sequence
uggcucacaccuuuaaucccag

SEQ ID NO: 13903 - RNA, 22 nt, Artificial Sequence
  Guide Sequence
uggcucacacuuguaaucccag

SEQ ID NO: 13904 - RNA, 22 nt, Artificial Sequence
  Guide Sequence
ugggaaaagauggaagaauaaa

SEQ ID NO: 13905 - RNA, 22 nt, Artificial Sequence
  Guide Sequence
ugggaggcugaggcaggagaau

SEQ ID NO: 13906 - RNA, 22 nt, Artificial Sequence
  Guide Sequence
ugggcaccccgauuugugguuu

SEQ ID NO: 13907 - RNA, 22 nt, Artificial Sequence
  Guide Sequence
ugggcccccucacccaagggaa

SEQ ID NO: 13908 - RNA, 22 nt, Artificial Sequence
  Guide Sequence
ugggcgacagagcaagagacuc

SEQ ID NO: 13909 - RNA, 22 nt, Artificial Sequence
  Guide Sequence
uggggcacuuuguaacagcuac

SEQ ID NO: 13910 - RNA, 22 nt, Artificial Sequence
  Guide Sequence
uggguauucccccauuucacag

SEQ ID NO: 13911 - RNA, 22 nt, Artificial Sequence
  Guide Sequence
ugguuucaaaugcaucuaucuc

SEQ ID NO: 13912 - RNA, 22 nt, Artificial Sequence
  Guide Sequence
uguaacagcuaccuaacuaccc

SEQ ID NO: 13913 - RNA, 22 nt, Artificial Sequence
  Guide Sequence
uguaaucccagcacuuugggag

SEQ ID NO: 13914 - RNA, 22 nt, Artificial Sequence
  Guide Sequence
ugugggaaaagauggaagaaua

SEQ ID NO: 13915 - RNA, 22 nt, Artificial Sequence
  Guide Sequence
uguggguauucccccauuucac

SEQ ID NO: 13916 - RNA, 22 nt, Artificial Sequence
  Guide Sequence
ugugguuucaaaugcaucuauc

SEQ ID NO: 13917 - RNA, 22 nt, Artificial Sequence
  Guide Sequence
uuaaucccagcacucuggaagg

SEQ ID NO: 13918 - RNA, 22 nt, Artificial Sequence
  Guide Sequence
uuagucaagggggucucugcug

SEQ ID NO: 13919 - RNA, 22 nt, Artificial Sequence
  Guide Sequence
uucaaaugcaucuaucucaucu

SEQ ID NO: 13920 - RNA, 22 nt, Artificial Sequence
  Guide Sequence
uucccccauuucacagacgugg

SEQ ID NO: 13921 - RNA, 22 nt, Artificial Sequence
  Guide Sequence
uuccucaugccccugaagaaca

SEQ ID NO: 13922 - RNA, 22 nt, Artificial Sequence
  Guide Sequence
uucucacuguggguauuccccc

SEQ ID NO: 13923 - RNA, 22 nt, Artificial Sequence
  Guide Sequence
uugaacccagaaggcggagauu

SEQ ID NO: 13924 - RNA, 22 nt, Artificial Sequence
  Guide Sequence
uugcagugagcugagauggcgc

SEQ ID NO: 13925 - RNA, 22 nt, Artificial Sequence
  Guide Sequence
uugggaggcugaggcaggagaa

SEQ ID NO: 13926 - RNA, 22 nt, Artificial Sequence
  Guide Sequence
uuguaacagcuaccuaacuacc

SEQ ID NO: 13927 - RNA, 22 nt, Artificial Sequence
  Guide Sequence
uuguaaucccagcacuuuggga

SEQ ID NO: 13928 - RNA, 22 nt, Artificial Sequence
  Guide Sequence
uugugguuucaaaugcaucuau

SEQ ID NO: 13929 - RNA, 22 nt, Artificial Sequence
  Guide Sequence
uuuaaucccagcacucuggaag

SEQ ID NO: 13930 - RNA, 22 nt, Artificial Sequence
  Guide Sequence
uuucaaaugcaucuaucucauc

SEQ ID NO: 13931 - RNA, 22 nt, Artificial Sequence
  Guide Sequence
uuugaacccagaaggcggagau

SEQ ID NO: 13932 - RNA, 22 nt, Artificial Sequence
  Guide Sequence
uuugggaggcugaggcaggaga

SEQ ID NO: 13933 - RNA, 22 nt, Artificial Sequence
  Guide Sequence
uuuguaacagcuaccuaacuac

SEQ ID NO: 13934 - RNA, 22 nt, Artificial Sequence
  Guide Sequence
uuugugguuucaaaugcaucua

SEQ ID NO: 13935 - RNA, 20 nt, Artificial Sequence
  Guide Sequence
aaaagggguuguuccgccgu

SEQ ID NO: 13936 - RNA, 20 nt, Artificial Sequence
  Guide Sequence
aaagggguuguuccgccgug

SEQ ID NO: 13937 - RNA, 20 nt, Artificial Sequence
  Guide Sequence
aacagccacuuccacccgga

SEQ ID NO: 13938 - RNA, 20 nt, Artificial Sequence
  Guide Sequence
aaccgagcgugggccccggg

SEQ ID NO: 13939 - RNA, 20 nt, Artificial Sequence
  Guide Sequence
aacuuccgcccugagaaggg

SEQ ID NO: 13940 - RNA, 20 nt, Artificial Sequence
  Guide Sequence
aagaugauagccacauuucu

SEQ ID NO: 13941 - RNA, 20 nt, Artificial Sequence
  Guide Sequence
aagcaacuuccgcccugaga

SEQ ID NO: 13942 - RNA, 20 nt, Artificial Sequence
  Guide Sequence
aagccucagagcgcgugccu

SEQ ID NO: 13943 - RNA, 20 nt, Artificial Sequence
  Guide Sequence
aagcgggggcuccgagcugg

SEQ ID NO: 13944 - RNA, 20 nt, Artificial Sequence
  Guide Sequence
aaggacggaagaugauagcc

SEQ ID NO: 13945 - RNA, 20 nt, Artificial Sequence
  Guide Sequence
aagggguuguuccgccgugg

SEQ ID NO: 13946 - RNA, 20 nt, Artificial Sequence
  Guide Sequence
aaggguggggcuuccgucuc

SEQ ID NO: 13947 - RNA, 20 nt, Artificial Sequence
  Guide Sequence
acagccacuuccacccggaa

SEQ ID NO: 13948 - RNA, 20 nt, Artificial Sequence
  Guide Sequence
acaguuccgcccuuacuacu

SEQ ID NO: 13949 - RNA, 20 nt, Artificial Sequence
  Guide Sequence
acaugcccggucagcgccgu

SEQ ID NO: 13950 - RNA, 20 nt, Artificial Sequence
  Guide Sequence
acauuucuuccucgcccuuc

SEQ ID NO: 13951 - RNA, 20 nt, Artificial Sequence
  Guide Sequence
acccggaaaagggguuguuc

SEQ ID NO: 13952 - RNA, 20 nt, Artificial Sequence
  Guide Sequence
acgccgaagccucagagcgc

SEQ ID NO: 13953 - RNA, 20 nt, Artificial Sequence
  Guide Sequence
acggaagaugauagccacau

SEQ ID NO: 13954 - RNA, 20 nt, Artificial Sequence
  Guide Sequence
acgugcgagcggcaggcccg

SEQ ID NO: 13955 - RNA, 20 nt, Artificial Sequence
  Guide Sequence
acuacucccacuuccggcca

SEQ ID NO: 13956 - RNA, 20 nt, Artificial Sequence
  Guide Sequence
acucccacuuccggccaggg

SEQ ID NO: 13957 - RNA, 20 nt, Artificial Sequence
  Guide Sequence
acuccuggcggugaaggacg

SEQ ID NO: 13958 - RNA, 20 nt, Artificial Sequence
  Guide Sequence
acuuccacccggaaaagggg

SEQ ID NO: 13959 - RNA, 20 nt, Artificial Sequence
  Guide Sequence
acuuccgcccugagaagggu

SEQ ID NO: 13960 - RNA, 20 nt, Artificial Sequence
  Guide Sequence
acuuccggccagggaacagc

SEQ ID NO: 13961 - RNA, 20 nt, Artificial Sequence
  Guide Sequence
agaaggguggggcuuccguc

SEQ ID NO: 13962 - RNA, 20 nt, Artificial Sequence
  Guide Sequence
agagccgcggccacgugcga

SEQ ID NO: 13963 - RNA, 20 nt, Artificial Sequence
  Guide Sequence
agagcgcgugccugagggcc

SEQ ID NO: 13964 - RNA, 20 nt, Artificial Sequence
  Guide Sequence
agaugauagccacauuucuu

SEQ ID NO: 13965 - RNA, 20 nt, Artificial Sequence
  Guide Sequence
agcaacuuccgcccugagaa

SEQ ID NO: 13966 - RNA, 20 nt, Artificial Sequence
  Guide Sequence
agccacauuucuuccucgcc

SEQ ID NO: 13967 - RNA, 20 nt, Artificial Sequence
  Guide Sequence
agccacuuccacccggaaaa

SEQ ID NO: 13968 - RNA, 20 nt, Artificial Sequence
  Guide Sequence
agccgcggccacgugcgagc

SEQ ID NO: 13969 - RNA, 20 nt, Artificial Sequence
  Guide Sequence
agccucagagcgcgugccug

SEQ ID NO: 13970 - RNA, 20 nt, Artificial Sequence
  Guide Sequence
agcgccguccgggaaccgag

SEQ ID NO: 13971 - RNA, 20 nt, Artificial Sequence
  Guide Sequence
agcgcgugccugagggcccc

SEQ ID NO: 13972 - RNA, 20 nt, Artificial Sequence
  Guide Sequence
agcggcaggcccggacaugc

SEQ ID NO: 13973 - RNA, 20 nt, Artificial Sequence
  Guide Sequence
agcgggggcuccgagcugga

SEQ ID NO: 13974 - RNA, 20 nt, Artificial Sequence
  Guide Sequence
agcuguggcccacccauccu

SEQ ID NO: 13975 - RNA, 20 nt, Artificial Sequence
  Guide Sequence
aggacggaagaugauagcca

SEQ ID NO: 13976 - RNA, 20 nt, Artificial Sequence
  Guide Sequence
aggcccggacaugcccgguc

SEQ ID NO: 13977 - RNA, 20 nt, Artificial Sequence
  Guide Sequence
agggaacagccacuuccacc

SEQ ID NO: 13978 - RNA, 20 nt, Artificial Sequence
  Guide Sequence
agggccggacgccgaagccu

SEQ ID NO: 13979 - RNA, 20 nt, Artificial Sequence
  Guide Sequence
agggguuguuccgccguggg

SEQ ID NO: 13980 - RNA, 20 nt, Artificial Sequence
  Guide Sequence
aggguggggcuuccgucucc

SEQ ID NO: 13981 - RNA, 20 nt, Artificial Sequence
  Guide Sequence
agguucccugucacaguucc

SEQ ID NO: 13982 - RNA, 20 nt, Artificial Sequence
  Guide Sequence
agucccggggcuggggagug

SEQ ID NO: 13983 - RNA, 20 nt, Artificial Sequence
  Guide Sequence
aguuccgcccuuacuacucc

SEQ ID NO: 13984 - RNA, 20 nt, Artificial Sequence
  Guide Sequence
auagccacauuucuuccucg

SEQ ID NO: 13985 - RNA, 20 nt, Artificial Sequence
  Guide Sequence
augauagccacauuucuucc

SEQ ID NO: 13986 - RNA, 20 nt, Artificial Sequence
  Guide Sequence
augcccggucagcgccgucc

SEQ ID NO: 13987 - RNA, 20 nt, Artificial Sequence
  Guide Sequence
auuucuuccucgcccuuccc

SEQ ID NO: 13988 - RNA, 20 nt, Artificial Sequence
  Guide Sequence
caacuuccgcccugagaagg

SEQ ID NO: 13989 - RNA, 20 nt, Artificial Sequence
  Guide Sequence
cacaguuccgcccuuacuac

SEQ ID NO: 13990 - RNA, 20 nt, Artificial Sequence
  Guide Sequence
cacauuucuuccucgcccuu

SEQ ID NO: 13991 - RNA, 20 nt, Artificial Sequence
  Guide Sequence
cacccggaaaagggguuguu

SEQ ID NO: 13992 - RNA, 20 nt, Artificial Sequence
  Guide Sequence
cacgugcgagcggcaggccc

SEQ ID NO: 13993 - RNA, 20 nt, Artificial Sequence
  Guide Sequence
cacuuccacccggaaaaggg

SEQ ID NO: 13994 - RNA, 20 nt, Artificial Sequence
  Guide Sequence
cacuuccggccagggaacag

SEQ ID NO: 13995 - RNA, 20 nt, Artificial Sequence
  Guide Sequence
cagagcgcgugccugagggc

SEQ ID NO: 13996 - RNA, 20 nt, Artificial Sequence
  Guide Sequence
cagccacuuccacccggaaa

SEQ ID NO: 13997 - RNA, 20 nt, Artificial Sequence
  Guide Sequence
cagcgccguccgggaaccga

SEQ ID NO: 13998 - RNA, 20 nt, Artificial Sequence
  Guide Sequence
cagcuguggcccacccaucc

SEQ ID NO: 13999 - RNA, 20 nt, Artificial Sequence
  Guide Sequence
caggcccggacaugcccggu

SEQ ID NO: 14000 - RNA, 20 nt, Artificial Sequence
  Guide Sequence
cagggaacagccacuuccac

SEQ ID NO: 14001 - RNA, 20 nt, Artificial Sequence
  Guide Sequence
cagggccggacgccgaagcc

SEQ ID NO: 14002 - RNA, 20 nt, Artificial Sequence
  Guide Sequence
caguuccgcccuuacuacuc

SEQ ID NO: 14003 - RNA, 20 nt, Artificial Sequence
  Guide Sequence
caugcccggucagcgccguc

SEQ ID NO: 14004 - RNA, 20 nt, Artificial Sequence
  Guide Sequence
cauuucuuccucgcccuucc

SEQ ID NO: 14005 - RNA, 20 nt, Artificial Sequence
  Guide Sequence
ccacauuucuuccucgcccu

SEQ ID NO: 14006 - RNA, 20 nt, Artificial Sequence
  Guide Sequence
ccacccggaaaagggguugu

SEQ ID NO: 14007 - RNA, 20 nt, Artificial Sequence
  Guide Sequence
ccacgugcgagcggcaggcc

SEQ ID NO: 14008 - RNA, 20 nt, Artificial Sequence
  Guide Sequence
ccacuuccacccggaaaagg

SEQ ID NO: 14009 - RNA, 20 nt, Artificial Sequence
  Guide Sequence
ccacuuccggccagggaaca

SEQ ID NO: 14010 - RNA, 20 nt, Artificial Sequence
  Guide Sequence
ccagcuguggcccacccauc

SEQ ID NO: 14011 - RNA, 20 nt, Artificial Sequence
  Guide Sequence
ccagggaacagccacuucca

SEQ ID NO: 14012 - RNA, 20 nt, Artificial Sequence
  Guide Sequence
cccacuuccggccagggaac

SEQ ID NO: 14013 - RNA, 20 nt, Artificial Sequence
  Guide Sequence
cccccuagagccgcggccac

SEQ ID NO: 14014 - RNA, 20 nt, Artificial Sequence
  Guide Sequence
ccccggccgugcugaagcaa

SEQ ID NO: 14015 - RNA, 20 nt, Artificial Sequence
  Guide Sequence
ccccuagagccgcggccacg

SEQ ID NO: 14016 - RNA, 20 nt, Artificial Sequence
  Guide Sequence
ccccuagguucccugucaca

SEQ ID NO: 14017 - RNA, 20 nt, Artificial Sequence
  Guide Sequence
cccgcucucgcgacuccugg

SEQ ID NO: 14018 - RNA, 20 nt, Artificial Sequence
  Guide Sequence
cccggaaaagggguuguucc

SEQ ID NO: 14019 - RNA, 20 nt, Artificial Sequence
  Guide Sequence
cccggacaugcccggucagc

SEQ ID NO: 14020 - RNA, 20 nt, Artificial Sequence
  Guide Sequence
cccggccgugcugaagcaac

SEQ ID NO: 14021 - RNA, 20 nt, Artificial Sequence
  Guide Sequence
cccgucccgcccccuagagc

SEQ ID NO: 14022 - RNA, 20 nt, Artificial Sequence
  Guide Sequence
cccuagagccgcggccacgu

SEQ ID NO: 14023 - RNA, 20 nt, Artificial Sequence
  Guide Sequence
cccuagguucccugucacag

SEQ ID NO: 14024 - RNA, 20 nt, Artificial Sequence
  Guide Sequence
cccugagaaggguggggcuu

SEQ ID NO: 14025 - RNA, 20 nt, Artificial Sequence
  Guide Sequence
cccugucacaguuccgcccu

SEQ ID NO: 14026 - RNA, 20 nt, Artificial Sequence
  Guide Sequence
cccuuacuacucccacuucc

SEQ ID NO: 14027 - RNA, 20 nt, Artificial Sequence
  Guide Sequence
cccuuccccuagguucccug

SEQ ID NO: 14028 - RNA, 20 nt, Artificial Sequence
  Guide Sequence
ccgaagccucagagcgcgug

SEQ ID NO: 14029 - RNA, 20 nt, Artificial Sequence
  Guide Sequence
ccgcccugagaagggugggg

SEQ ID NO: 14030 - RNA, 20 nt, Artificial Sequence
  Guide Sequence
ccgcccuuacuacucccacu

SEQ ID NO: 14031 - RNA, 20 nt, Artificial Sequence
  Guide Sequence
ccgcucucgcgacuccuggc

SEQ ID NO: 14032 - RNA, 20 nt, Artificial Sequence
  Guide Sequence
ccggaaaagggguuguuccg

SEQ ID NO: 14033 - RNA, 20 nt, Artificial Sequence
  Guide Sequence
ccggacaugcccggucagcg

SEQ ID NO: 14034 - RNA, 20 nt, Artificial Sequence
  Guide Sequence
ccggacgccgaagccucaga

SEQ ID NO: 14035 - RNA, 20 nt, Artificial Sequence
  Guide Sequence
ccggccagggaacagccacu

SEQ ID NO: 14036 - RNA, 20 nt, Artificial Sequence
  Guide Sequence
ccggccgugcugaagcaacu

SEQ ID NO: 14037 - RNA, 20 nt, Artificial Sequence
  Guide Sequence
ccgggaaccgagcgugggcc

SEQ ID NO: 14038 - RNA, 20 nt, Artificial Sequence
  Guide Sequence
ccggucagcgccguccggga

SEQ ID NO: 14039 - RNA, 20 nt, Artificial Sequence
  Guide Sequence
ccgucccgcccccuagagcc

SEQ ID NO: 14040 - RNA, 20 nt, Artificial Sequence
  Guide Sequence
ccguccgggaaccgagcgug

SEQ ID NO: 14041 - RNA, 20 nt, Artificial Sequence
  Guide Sequence
ccgucucccgcucucgcgac

SEQ ID NO: 14042 - RNA, 20 nt, Artificial Sequence
  Guide Sequence
ccgugcugaagcaacuuccg

SEQ ID NO: 14043 - RNA, 20 nt, Artificial Sequence
  Guide Sequence
ccguggggcgccagcugugg

SEQ ID NO: 14044 - RNA, 20 nt, Artificial Sequence
  Guide Sequence
ccuagagccgcggccacgug

SEQ ID NO: 14045 - RNA, 20 nt, Artificial Sequence
  Guide Sequence
ccuagguucccugucacagu

SEQ ID NO: 14046 - RNA, 20 nt, Artificial Sequence
  Guide Sequence
ccucagagcgcgugccugag

SEQ ID NO: 14047 - RNA, 20 nt, Artificial Sequence
  Guide Sequence
ccucgcccuuccccuagguu

SEQ ID NO: 14048 - RNA, 20 nt, Artificial Sequence
  Guide Sequence
ccugagaaggguggggcuuc

SEQ ID NO: 14049 - RNA, 20 nt, Artificial Sequence
  Guide Sequence
ccuggcggugaaggacggaa

SEQ ID NO: 14050 - RNA, 20 nt, Artificial Sequence
  Guide Sequence
ccugucacaguuccgcccuu

SEQ ID NO: 14051 - RNA, 20 nt, Artificial Sequence
  Guide Sequence
ccuuacuacucccacuuccg

SEQ ID NO: 14052 - RNA, 20 nt, Artificial Sequence
  Guide Sequence
ccuuccccuagguucccugu

SEQ ID NO: 14053 - RNA, 20 nt, Artificial Sequence
  Guide Sequence
cgaagccucagagcgcgugc

SEQ ID NO: 14054 - RNA, 20 nt, Artificial Sequence
  Guide Sequence
cgacuccuggcggugaagga

SEQ ID NO: 14055 - RNA, 20 nt, Artificial Sequence
  Guide Sequence
cgagcggcaggcccggacau

SEQ ID NO: 14056 - RNA, 20 nt, Artificial Sequence
  Guide Sequence
cgccagcuguggcccaccca

SEQ ID NO: 14057 - RNA, 20 nt, Artificial Sequence
  Guide Sequence
cgccccggccgugcugaagc

SEQ ID NO: 14058 - RNA, 20 nt, Artificial Sequence
  Guide Sequence
cgcccugagaaggguggggc

SEQ ID NO: 14059 - RNA, 20 nt, Artificial Sequence
  Guide Sequence
cgcccuuacuacucccacuu

SEQ ID NO: 14060 - RNA, 20 nt, Artificial Sequence
  Guide Sequence
cgcccuuccccuagguuccc

SEQ ID NO: 14061 - RNA, 20 nt, Artificial Sequence
  Guide Sequence
cgccgaagccucagagcgcg

SEQ ID NO: 14062 - RNA, 20 nt, Artificial Sequence
  Guide Sequence
cgccguccgggaaccgagcg

SEQ ID NO: 14063 - RNA, 20 nt, Artificial Sequence
  Guide Sequence
cgccguggggcgccagcugu

SEQ ID NO: 14064 - RNA, 20 nt, Artificial Sequence
  Guide Sequence
cgcgacuccuggcggugaag

SEQ ID NO: 14065 - RNA, 20 nt, Artificial Sequence
  Guide Sequence
cgcgugccugagggccccga

SEQ ID NO: 14066 - RNA, 20 nt, Artificial Sequence
  Guide Sequence
cgcucucgcgacuccuggcg

SEQ ID NO: 14067 - RNA, 20 nt, Artificial Sequence
  Guide Sequence
cggaaaagggguuguuccgc

SEQ ID NO: 14068 - RNA, 20 nt, Artificial Sequence
  Guide Sequence
cggaagaugauagccacauu

SEQ ID NO: 14069 - RNA, 20 nt, Artificial Sequence
  Guide Sequence
cggacaugcccggucagcgc

SEQ ID NO: 14070 - RNA, 20 nt, Artificial Sequence
  Guide Sequence
cggacgccgaagccucagag

SEQ ID NO: 14071 - RNA, 20 nt, Artificial Sequence
  Guide Sequence
cggagucccggggcugggga

SEQ ID NO: 14072 - RNA, 20 nt, Artificial Sequence
  Guide Sequence
cggcaggcccggacaugccc

SEQ ID NO: 14073 - RNA, 20 nt, Artificial Sequence
  Guide Sequence
cggcagggccggacgccgaa

SEQ ID NO: 14074 - RNA, 20 nt, Artificial Sequence
  Guide Sequence
cggccacgugcgagcggcag

SEQ ID NO: 14075 - RNA, 20 nt, Artificial Sequence
  Guide Sequence
cggccagggaacagccacuu

SEQ ID NO: 14076 - RNA, 20 nt, Artificial Sequence
  Guide Sequence
cggccgugcugaagcaacuu

SEQ ID NO: 14077 - RNA, 20 nt, Artificial Sequence
  Guide Sequence
cgggaaccgagcgugggccc

SEQ ID NO: 14078 - RNA, 20 nt, Artificial Sequence
  Guide Sequence
cgggggcuccgagcuggacc

SEQ ID NO: 14079 - RNA, 20 nt, Artificial Sequence
  Guide Sequence
cggucagcgccguccgggaa

SEQ ID NO: 14080 - RNA, 20 nt, Artificial Sequence
  Guide Sequence
cggugaaggacggaagauga

SEQ ID NO: 14081 - RNA, 20 nt, Artificial Sequence
  Guide Sequence
cgucccgcccccuagagccg

SEQ ID NO: 14082 - RNA, 20 nt, Artificial Sequence
  Guide Sequence
cguccggagucccggggcug

SEQ ID NO: 14083 - RNA, 20 nt, Artificial Sequence
  Guide Sequence
cguccgggaaccgagcgugg

SEQ ID NO: 14084 - RNA, 20 nt, Artificial Sequence
  Guide Sequence
cgucucccgcucucgcgacu

SEQ ID NO: 14085 - RNA, 20 nt, Artificial Sequence
  Guide Sequence
cgugccugagggccccgagg

SEQ ID NO: 14086 - RNA, 20 nt, Artificial Sequence
  Guide Sequence
cgugcugaagcaacuuccgc

SEQ ID NO: 14087 - RNA, 20 nt, Artificial Sequence
  Guide Sequence
cguggggcgccagcuguggc

SEQ ID NO: 14088 - RNA, 20 nt, Artificial Sequence
  Guide Sequence
cguggggcguccggaguccc

SEQ ID NO: 14089 - RNA, 20 nt, Artificial Sequence
  Guide Sequence
cuacucccacuuccggccag

SEQ ID NO: 14090 - RNA, 20 nt, Artificial Sequence
  Guide Sequence
cuagagccgcggccacgugc

SEQ ID NO: 14091 - RNA, 20 nt, Artificial Sequence
  Guide Sequence
cuagguucccugucacaguu

SEQ ID NO: 14092 - RNA, 20 nt, Artificial Sequence
  Guide Sequence
cucagagcgcgugccugagg

SEQ ID NO: 14093 - RNA, 20 nt, Artificial Sequence
  Guide Sequence
cucccacuuccggccaggga

SEQ ID NO: 14094 - RNA, 20 nt, Artificial Sequence
  Guide Sequence
cucccgcucucgcgacuccu

SEQ ID NO: 14095 - RNA, 20 nt, Artificial Sequence
  Guide Sequence
cuccgagcuggaccgggcgc

SEQ ID NO: 14096 - RNA, 20 nt, Artificial Sequence
  Guide Sequence
cuccuggcggugaaggacgg

SEQ ID NO: 14097 - RNA, 20 nt, Artificial Sequence
  Guide Sequence
cucgccccggccgugcugaa

SEQ ID NO: 14098 - RNA, 20 nt, Artificial Sequence
  Guide Sequence
cucgcccuuccccuagguuc

SEQ ID NO: 14099 - RNA, 20 nt, Artificial Sequence
  Guide Sequence
cucgcgacuccuggcgguga

SEQ ID NO: 14100 - RNA, 20 nt, Artificial Sequence
  Guide Sequence
cucucgcgacuccuggcggu

SEQ ID NO: 14101 - RNA, 20 nt, Artificial Sequence
  Guide Sequence
cugaagcaacuuccgcccug

SEQ ID NO: 14102 - RNA, 20 nt, Artificial Sequence
  Guide Sequence
cugagaaggguggggcuucc

SEQ ID NO: 14103 - RNA, 20 nt, Artificial Sequence
  Guide Sequence
cuggcggugaaggacggaag

SEQ ID NO: 14104 - RNA, 20 nt, Artificial Sequence
  Guide Sequence
cugucacaguuccgcccuua

SEQ ID NO: 14105 - RNA, 20 nt, Artificial Sequence
  Guide Sequence
cuuacuacucccacuuccgg

SEQ ID NO: 14106 - RNA, 20 nt, Artificial Sequence
  Guide Sequence
cuuccacccggaaaaggggu

SEQ ID NO: 14107 - RNA, 20 nt, Artificial Sequence
  Guide Sequence
cuuccccuagguucccuguc

SEQ ID NO: 14108 - RNA, 20 nt, Artificial Sequence
  Guide Sequence
cuuccgcccugagaagggug

SEQ ID NO: 14109 - RNA, 20 nt, Artificial Sequence
  Guide Sequence
cuuccggccagggaacagcc

SEQ ID NO: 14110 - RNA, 20 nt, Artificial Sequence
  Guide Sequence
cuuccgucucccgcucucgc

SEQ ID NO: 14111 - RNA, 20 nt, Artificial Sequence
  Guide Sequence
cuuccucgcccuuccccuag

SEQ ID NO: 14112 - RNA, 20 nt, Artificial Sequence
  Guide Sequence
gaaaagggguuguuccgccg

SEQ ID NO: 14113 - RNA, 20 nt, Artificial Sequence
  Guide Sequence
gaacagccacuuccacccgg

SEQ ID NO: 14114 - RNA, 20 nt, Artificial Sequence
  Guide Sequence
gaaccgagcgugggccccgg

SEQ ID NO: 14115 - RNA, 20 nt, Artificial Sequence
  Guide Sequence
gaagaugauagccacauuuc

SEQ ID NO: 14116 - RNA, 20 nt, Artificial Sequence
  Guide Sequence
gaagcaacuuccgcccugag

SEQ ID NO: 14117 - RNA, 20 nt, Artificial Sequence
  Guide Sequence
gaagccucagagcgcgugcc

SEQ ID NO: 14118 - RNA, 20 nt, Artificial Sequence
  Guide Sequence
gaaggacggaagaugauagc

SEQ ID NO: 14119 - RNA, 20 nt, Artificial Sequence
  Guide Sequence
gaaggguggggcuuccgucu

SEQ ID NO: 14120 - RNA, 20 nt, Artificial Sequence
  Guide Sequence
gacaugcccggucagcgccg

SEQ ID NO: 14121 - RNA, 20 nt, Artificial Sequence
  Guide Sequence
gacgccgaagccucagagcg

SEQ ID NO: 14122 - RNA, 20 nt, Artificial Sequence
  Guide Sequence
gacggaagaugauagccaca

SEQ ID NO: 14123 - RNA, 20 nt, Artificial Sequence
  Guide Sequence
gacuccuggcggugaaggac

SEQ ID NO: 14124 - RNA, 20 nt, Artificial Sequence
  Guide Sequence
gagaaggguggggcuuccgu

SEQ ID NO: 14125 - RNA, 20 nt, Artificial Sequence
  Guide Sequence
gagccgcggccacgugcgag

SEQ ID NO: 14126 - RNA, 20 nt, Artificial Sequence
  Guide Sequence
gagcgcgugccugagggccc

SEQ ID NO: 14127 - RNA, 20 nt, Artificial Sequence
  Guide Sequence
gagcggcaggcccggacaug

SEQ ID NO: 14128 - RNA, 20 nt, Artificial Sequence
  Guide Sequence
gagucccggggcuggggagu

SEQ ID NO: 14129 - RNA, 20 nt, Artificial Sequence
  Guide Sequence
gauagccacauuucuuccuc

SEQ ID NO: 14130 - RNA, 20 nt, Artificial Sequence
  Guide Sequence
gaugauagccacauuucuuc

SEQ ID NO: 14131 - RNA, 20 nt, Artificial Sequence
  Guide Sequence
gcaacuuccgcccugagaag

SEQ ID NO: 14132 - RNA, 20 nt, Artificial Sequence
  Guide Sequence
gcaggcccggacaugcccgg

SEQ ID NO: 14133 - RNA, 20 nt, Artificial Sequence
  Guide Sequence
gcagggccggacgccgaagc

SEQ ID NO: 14134 - RNA, 20 nt, Artificial Sequence
  Guide Sequence
gccacauuucuuccucgccc

SEQ ID NO: 14135 - RNA, 20 nt, Artificial Sequence
  Guide Sequence
gccacgugcgagcggcaggc

SEQ ID NO: 14136 - RNA, 20 nt, Artificial Sequence
  Guide Sequence
gccacuuccacccggaaaag

SEQ ID NO: 14137 - RNA, 20 nt, Artificial Sequence
  Guide Sequence
gccagcuguggcccacccau

SEQ ID NO: 14138 - RNA, 20 nt, Artificial Sequence
  Guide Sequence
gccagggaacagccacuucc

SEQ ID NO: 14139 - RNA, 20 nt, Artificial Sequence
  Guide Sequence
gcccccuagagccgcggcca

SEQ ID NO: 14140 - RNA, 20 nt, Artificial Sequence
  Guide Sequence
gccccggccgugcugaagca

SEQ ID NO: 14141 - RNA, 20 nt, Artificial Sequence
  Guide Sequence
gcccggacaugcccggucag

SEQ ID NO: 14142 - RNA, 20 nt, Artificial Sequence
  Guide Sequence
gcccgucccgcccccuagag

SEQ ID NO: 14143 - RNA, 20 nt, Artificial Sequence
  Guide Sequence
gcccugagaaggguggggcu

SEQ ID NO: 14144 - RNA, 20 nt, Artificial Sequence
  Guide Sequence
gcccuuacuacucccacuuc

SEQ ID NO: 14145 - RNA, 20 nt, Artificial Sequence
  Guide Sequence
gcccuuccccuagguucccu

SEQ ID NO: 14146 - RNA, 20 nt, Artificial Sequence
  Guide Sequence
gccgaagccucagagcgcgu

SEQ ID NO: 14147 - RNA, 20 nt, Artificial Sequence
  Guide Sequence
gccggacgccgaagccucag

SEQ ID NO: 14148 - RNA, 20 nt, Artificial Sequence
  Guide Sequence
gccguccgggaaccgagcgu

SEQ ID NO: 14149 - RNA, 20 nt, Artificial Sequence
  Guide Sequence
gccgugcugaagcaacuucc

SEQ ID NO: 14150 - RNA, 20 nt, Artificial Sequence
  Guide Sequence
gccguggggcgccagcugug

SEQ ID NO: 14151 - RNA, 20 nt, Artificial Sequence
  Guide Sequence
gccucagagcgcgugccuga

SEQ ID NO: 14152 - RNA, 20 nt, Artificial Sequence
  Guide Sequence
gcgacuccuggcggugaagg

SEQ ID NO: 14153 - RNA, 20 nt, Artificial Sequence
  Guide Sequence
gcgagcggcaggcccggaca

SEQ ID NO: 14154 - RNA, 20 nt, Artificial Sequence
  Guide Sequence
gcgccagcuguggcccaccc

SEQ ID NO: 14155 - RNA, 20 nt, Artificial Sequence
  Guide Sequence
gcgccguccgggaaccgagc

SEQ ID NO: 14156 - RNA, 20 nt, Artificial Sequence
  Guide Sequence
gcggcaggcccggacaugcc

SEQ ID NO: 14157 - RNA, 20 nt, Artificial Sequence
  Guide Sequence
gcggccacgugcgagcggca

SEQ ID NO: 14158 - RNA, 20 nt, Artificial Sequence
  Guide Sequence
gcgggggcuccgagcuggac

SEQ ID NO: 14159 - RNA, 20 nt, Artificial Sequence
  Guide Sequence
gcggugaaggacggaagaug

SEQ ID NO: 14160 - RNA, 20 nt, Artificial Sequence
  Guide Sequence
gcguccggagucccggggcu

SEQ ID NO: 14161 - RNA, 20 nt, Artificial Sequence
  Guide Sequence
gcgugccugagggccccgag

SEQ ID NO: 14162 - RNA, 20 nt, Artificial Sequence
  Guide Sequence
gcguggggcguccggagucc

SEQ ID NO: 14163 - RNA, 20 nt, Artificial Sequence
  Guide Sequence
gcuccgagcuggaccgggcg

SEQ ID NO: 14164 - RNA, 20 nt, Artificial Sequence
  Guide Sequence
gcucgccccggccgugcuga

SEQ ID NO: 14165 - RNA, 20 nt, Artificial Sequence
  Guide Sequence
gcucucgcgacuccuggcgg

SEQ ID NO: 14166 - RNA, 20 nt, Artificial Sequence
  Guide Sequence
gcugaagcaacuuccgcccu

SEQ ID NO: 14167 - RNA, 20 nt, Artificial Sequence
  Guide Sequence
gcuuccgucucccgcucucg

SEQ ID NO: 14168 - RNA, 20 nt, Artificial Sequence
  Guide Sequence
ggaaaagggguuguuccgcc

SEQ ID NO: 14169 - RNA, 20 nt, Artificial Sequence
  Guide Sequence
ggaacagccacuuccacccg

SEQ ID NO: 14170 - RNA, 20 nt, Artificial Sequence
  Guide Sequence
ggaaccgagcgugggccccg

SEQ ID NO: 14171 - RNA, 20 nt, Artificial Sequence
  Guide Sequence
ggaagaugauagccacauuu

SEQ ID NO: 14172 - RNA, 20 nt, Artificial Sequence
  Guide Sequence
ggacaugcccggucagcgcc

SEQ ID NO: 14173 - RNA, 20 nt, Artificial Sequence
  Guide Sequence
ggacgccgaagccucagagc

SEQ ID NO: 14174 - RNA, 20 nt, Artificial Sequence
  Guide Sequence
ggacggaagaugauagccac

SEQ ID NO: 14175 - RNA, 20 nt, Artificial Sequence
  Guide Sequence
ggagucccggggcuggggag

SEQ ID NO: 14176 - RNA, 20 nt, Artificial Sequence
  Guide Sequence
ggcaggcccggacaugcccg

SEQ ID NO: 14177 - RNA, 20 nt, Artificial Sequence
  Guide Sequence
ggcagggccggacgccgaag

SEQ ID NO: 14178 - RNA, 20 nt, Artificial Sequence
  Guide Sequence
ggccacgugcgagcggcagg

SEQ ID NO: 14179 - RNA, 20 nt, Artificial Sequence
  Guide Sequence
ggccagggaacagccacuuc

SEQ ID NO: 14180 - RNA, 20 nt, Artificial Sequence
  Guide Sequence
ggcccggacaugcccgguca

SEQ ID NO: 14181 - RNA, 20 nt, Artificial Sequence
  Guide Sequence
ggcccgucccgcccccuaga

SEQ ID NO: 14182 - RNA, 20 nt, Artificial Sequence
  Guide Sequence
ggccggacgccgaagccuca

SEQ ID NO: 14183 - RNA, 20 nt, Artificial Sequence
  Guide Sequence
ggccgugcugaagcaacuuc

SEQ ID NO: 14184 - RNA, 20 nt, Artificial Sequence
  Guide Sequence
ggcgccagcuguggcccacc

SEQ ID NO: 14185 - RNA, 20 nt, Artificial Sequence
  Guide Sequence
ggcggugaaggacggaagau

SEQ ID NO: 14186 - RNA, 20 nt, Artificial Sequence
  Guide Sequence
ggcuccgagcuggaccgggc

SEQ ID NO: 14187 - RNA, 20 nt, Artificial Sequence
  Guide Sequence
ggcuuccgucucccgcucuc

SEQ ID NO: 14188 - RNA, 20 nt, Artificial Sequence
  Guide Sequence
gggaacagccacuuccaccc

SEQ ID NO: 14189 - RNA, 20 nt, Artificial Sequence
  Guide Sequence
gggaaccgagcgugggcccc

SEQ ID NO: 14190 - RNA, 20 nt, Artificial Sequence
  Guide Sequence
gggccggacgccgaagccuc

SEQ ID NO: 14191 - RNA, 20 nt, Artificial Sequence
  Guide Sequence
gggcgccagcuguggcccac

SEQ ID NO: 14192 - RNA, 20 nt, Artificial Sequence
  Guide Sequence
gggcuccgagcuggaccggg

SEQ ID NO: 14193 - RNA, 20 nt, Artificial Sequence
  Guide Sequence
gggcuuccgucucccgcucu

SEQ ID NO: 14194 - RNA, 20 nt, Artificial Sequence
  Guide Sequence
ggggcgccagcuguggccca

SEQ ID NO: 14195 - RNA, 20 nt, Artificial Sequence
  Guide Sequence
ggggcuccgagcuggaccgg

SEQ ID NO: 14196 - RNA, 20 nt, Artificial Sequence
  Guide Sequence
ggggcuuccgucucccgcuc

SEQ ID NO: 14197 - RNA, 20 nt, Artificial Sequence
  Guide Sequence
gggggcuccgagcuggaccg

SEQ ID NO: 14198 - RNA, 20 nt, Artificial Sequence
  Guide Sequence
gggguuguuccgccgugggg

SEQ ID NO: 14199 - RNA, 20 nt, Artificial Sequence
  Guide Sequence
gggugcguggggcguccgga

SEQ ID NO: 14200 - RNA, 20 nt, Artificial Sequence
  Guide Sequence
ggguggggcuuccgucuccc

SEQ ID NO: 14201 - RNA, 20 nt, Artificial Sequence
  Guide Sequence
ggguuguuccgccguggggc

SEQ ID NO: 14202 - RNA, 20 nt, Artificial Sequence
  Guide Sequence
gguaagcgggggcuccgagc

SEQ ID NO: 14203 - RNA, 20 nt, Artificial Sequence
  Guide Sequence
ggucagcgccguccgggaac

SEQ ID NO: 14204 - RNA, 20 nt, Artificial Sequence
  Guide Sequence
ggugaaggacggaagaugau

SEQ ID NO: 14205 - RNA, 20 nt, Artificial Sequence
  Guide Sequence
ggugcguggggcguccggag

SEQ ID NO: 14206 - RNA, 20 nt, Artificial Sequence
  Guide Sequence
gguggggcuuccgucucccg

SEQ ID NO: 14207 - RNA, 20 nt, Artificial Sequence
  Guide Sequence
gguucccugucacaguuccg

SEQ ID NO: 14208 - RNA, 20 nt, Artificial Sequence
  Guide Sequence
gguuguuccgccguggggcg

SEQ ID NO: 14209 - RNA, 20 nt, Artificial Sequence
  Guide Sequence
guaagcgggggcuccgagcu

SEQ ID NO: 14210 - RNA, 20 nt, Artificial Sequence
  Guide Sequence
gucacaguuccgcccuuacu

SEQ ID NO: 14211 - RNA, 20 nt, Artificial Sequence
  Guide Sequence
gucagcgccguccgggaacc

SEQ ID NO: 14212 - RNA, 20 nt, Artificial Sequence
  Guide Sequence
gucccgcccccuagagccgc

SEQ ID NO: 14213 - RNA, 20 nt, Artificial Sequence
  Guide Sequence
gucccggggcuggggagugg

SEQ ID NO: 14214 - RNA, 20 nt, Artificial Sequence
  Guide Sequence
guccggagucccggggcugg

SEQ ID NO: 14215 - RNA, 20 nt, Artificial Sequence
  Guide Sequence
guccgggaaccgagcguggg

SEQ ID NO: 14216 - RNA, 20 nt, Artificial Sequence
  Guide Sequence
gucucccgcucucgcgacuc

SEQ ID NO: 14217 - RNA, 20 nt, Artificial Sequence
  Guide Sequence
gugaaggacggaagaugaua

SEQ ID NO: 14218 - RNA, 20 nt, Artificial Sequence
  Guide Sequence
gugccugagggccccgaggc

SEQ ID NO: 14219 - RNA, 20 nt, Artificial Sequence
  Guide Sequence
gugcgagcggcaggcccgga

SEQ ID NO: 14220 - RNA, 20 nt, Artificial Sequence
  Guide Sequence
gugcguggggcguccggagu

SEQ ID NO: 14221 - RNA, 20 nt, Artificial Sequence
  Guide Sequence
gugcugaagcaacuuccgcc

SEQ ID NO: 14222 - RNA, 20 nt, Artificial Sequence
  Guide Sequence
guggggcgccagcuguggcc

SEQ ID NO: 14223 - RNA, 20 nt, Artificial Sequence
  Guide Sequence
guggggcguccggagucccg

SEQ ID NO: 14224 - RNA, 20 nt, Artificial Sequence
  Guide Sequence
guggggcuuccgucucccgc

SEQ ID NO: 14225 - RNA, 20 nt, Artificial Sequence
  Guide Sequence
guucccugucacaguuccgc

SEQ ID NO: 14226 - RNA, 20 nt, Artificial Sequence
  Guide Sequence
guuccgcccuuacuacuccc

SEQ ID NO: 14227 - RNA, 20 nt, Artificial Sequence
  Guide Sequence
guuccgccguggggcgccag

SEQ ID NO: 14228 - RNA, 20 nt, Artificial Sequence
  Guide Sequence
guuguuccgccguggggcgc

SEQ ID NO: 14229 - RNA, 20 nt, Artificial Sequence
  Guide Sequence
uaagcgggggcuccgagcug

SEQ ID NO: 14230 - RNA, 20 nt, Artificial Sequence
  Guide Sequence
uacuacucccacuuccggcc

SEQ ID NO: 14231 - RNA, 20 nt, Artificial Sequence
  Guide Sequence
uacucccacuuccggccagg

SEQ ID NO: 14232 - RNA, 20 nt, Artificial Sequence
  Guide Sequence
uagagccgcggccacgugcg

SEQ ID NO: 14233 - RNA, 20 nt, Artificial Sequence
  Guide Sequence
uagccacauuucuuccucgc

SEQ ID NO: 14234 - RNA, 20 nt, Artificial Sequence
  Guide Sequence
uagguucccugucacaguuc

SEQ ID NO: 14235 - RNA, 20 nt, Artificial Sequence
  Guide Sequence
ucacaguuccgcccuuacua

SEQ ID NO: 14236 - RNA, 20 nt, Artificial Sequence
  Guide Sequence
ucagagcgcgugccugaggg

SEQ ID NO: 14237 - RNA, 20 nt, Artificial Sequence
  Guide Sequence
ucagcgccguccgggaaccg

SEQ ID NO: 14238 - RNA, 20 nt, Artificial Sequence
  Guide Sequence
uccacccggaaaagggguug

SEQ ID NO: 14239 - RNA, 20 nt, Artificial Sequence
  Guide Sequence
ucccacuuccggccagggaa

SEQ ID NO: 14240 - RNA, 20 nt, Artificial Sequence
  Guide Sequence
uccccuagguucccugucac

SEQ ID NO: 14241 - RNA, 20 nt, Artificial Sequence
  Guide Sequence
ucccgcccccuagagccgcg

SEQ ID NO: 14242 - RNA, 20 nt, Artificial Sequence
  Guide Sequence
ucccgcucucgcgacuccug

SEQ ID NO: 14243 - RNA, 20 nt, Artificial Sequence
  Guide Sequence
ucccggggcuggggaguggg

SEQ ID NO: 14244 - RNA, 20 nt, Artificial Sequence
  Guide Sequence
ucccugucacaguuccgccc

SEQ ID NO: 14245 - RNA, 20 nt, Artificial Sequence
  Guide Sequence
uccgcccugagaaggguggg

SEQ ID NO: 14246 - RNA, 20 nt, Artificial Sequence
  Guide Sequence
uccgcccuuacuacucccac

SEQ ID NO: 14247 - RNA, 20 nt, Artificial Sequence
  Guide Sequence
uccgccguggggcgccagcu

SEQ ID NO: 14248 - RNA, 20 nt, Artificial Sequence
  Guide Sequence
uccggagucccggggcuggg

SEQ ID NO: 14249 - RNA, 20 nt, Artificial Sequence
  Guide Sequence
uccggccagggaacagccac

SEQ ID NO: 14250 - RNA, 20 nt, Artificial Sequence
  Guide Sequence
uccgggaaccgagcgugggc

SEQ ID NO: 14251 - RNA, 20 nt, Artificial Sequence
  Guide Sequence
uccgucucccgcucucgcga

SEQ ID NO: 14252 - RNA, 20 nt, Artificial Sequence
  Guide Sequence
uccucgcccuuccccuaggu

SEQ ID NO: 14253 - RNA, 20 nt, Artificial Sequence
  Guide Sequence
uccuggcggugaaggacgga

SEQ ID NO: 14254 - RNA, 20 nt, Artificial Sequence
  Guide Sequence
ucgccccggccgugcugaag

SEQ ID NO: 14255 - RNA, 20 nt, Artificial Sequence
  Guide Sequence
ucgcccuuccccuagguucc

SEQ ID NO: 14256 - RNA, 20 nt, Artificial Sequence
  Guide Sequence
ucgcgacuccuggcggugaa

SEQ ID NO: 14257 - RNA, 20 nt, Artificial Sequence
  Guide Sequence
ucgcucgccccggccgugcu

SEQ ID NO: 14258 - RNA, 20 nt, Artificial Sequence
  Guide Sequence
ucucccgcucucgcgacucc

SEQ ID NO: 14259 - RNA, 20 nt, Artificial Sequence
  Guide Sequence
ucucgcgacuccuggcggug

SEQ ID NO: 14260 - RNA, 20 nt, Artificial Sequence
  Guide Sequence
ucuuccucgcccuuccccua

SEQ ID NO: 14261 - RNA, 20 nt, Artificial Sequence
  Guide Sequence
ugaagcaacuuccgcccuga

SEQ ID NO: 14262 - RNA, 20 nt, Artificial Sequence
  Guide Sequence
ugaaggacggaagaugauag

SEQ ID NO: 14263 - RNA, 20 nt, Artificial Sequence
  Guide Sequence
ugagaaggguggggcuuccg

SEQ ID NO: 14264 - RNA, 20 nt, Artificial Sequence
  Guide Sequence
ugauagccacauuucuuccu

SEQ ID NO: 14265 - RNA, 20 nt, Artificial Sequence
  Guide Sequence
ugcccggucagcgccguccg

SEQ ID NO: 14266 - RNA, 20 nt, Artificial Sequence
  Guide Sequence
ugccugagggccccgaggcg

SEQ ID NO: 14267 - RNA, 20 nt, Artificial Sequence
  Guide Sequence
ugcgagcggcaggcccggac

SEQ ID NO: 14268 - RNA, 20 nt, Artificial Sequence
  Guide Sequence
ugcguggggcguccggaguc

SEQ ID NO: 14269 - RNA, 20 nt, Artificial Sequence
  Guide Sequence
ugcugaagcaacuuccgccc

SEQ ID NO: 14270 - RNA, 20 nt, Artificial Sequence
  Guide Sequence
uggcggugaaggacggaaga

SEQ ID NO: 14271 - RNA, 20 nt, Artificial Sequence
  Guide Sequence
uggggcgccagcuguggccc

SEQ ID NO: 14272 - RNA, 20 nt, Artificial Sequence
  Guide Sequence
uggggcguccggagucccgg

SEQ ID NO: 14273 - RNA, 20 nt, Artificial Sequence
  Guide Sequence
uggggcuuccgucucccgcu

SEQ ID NO: 14274 - RNA, 20 nt, Artificial Sequence
  Guide Sequence
ugucacaguuccgcccuuac

SEQ ID NO: 14275 - RNA, 20 nt, Artificial Sequence
  Guide Sequence
uguuccgccguggggcgcca

SEQ ID NO: 14276 - RNA, 20 nt, Artificial Sequence
  Guide Sequence
uuacuacucccacuuccggc

SEQ ID NO: 14277 - RNA, 20 nt, Artificial Sequence
  Guide Sequence
uuccacccggaaaagggguu

SEQ ID NO: 14278 - RNA, 20 nt, Artificial Sequence
  Guide Sequence
uuccccuagguucccuguca

SEQ ID NO: 14279 - RNA, 20 nt, Artificial Sequence
  Guide Sequence
uucccugucacaguuccgcc

SEQ ID NO: 14280 - RNA, 20 nt, Artificial Sequence
  Guide Sequence
uuccgcccugagaagggugg

SEQ ID NO: 14281 - RNA, 20 nt, Artificial Sequence
  Guide Sequence
uuccgcccuuacuacuccca

SEQ ID NO: 14282 - RNA, 20 nt, Artificial Sequence
  Guide Sequence
uuccgccguggggcgccagc

SEQ ID NO: 14283 - RNA, 20 nt, Artificial Sequence
  Guide Sequence
uuccggccagggaacagcca

SEQ ID NO: 14284 - RNA, 20 nt, Artificial Sequence
  Guide Sequence
uuccgucucccgcucucgcg

SEQ ID NO: 14285 - RNA, 20 nt, Artificial Sequence
  Guide Sequence
uuccucgcccuuccccuagg

SEQ ID NO: 14286 - RNA, 20 nt, Artificial Sequence
  Guide Sequence
uucgcucgccccggccgugc

SEQ ID NO: 14287 - RNA, 20 nt, Artificial Sequence
  Guide Sequence
uucuuccucgcccuuccccu

SEQ ID NO: 14288 - RNA, 20 nt, Artificial Sequence
  Guide Sequence
uuguuccgccguggggcgcc

SEQ ID NO: 14289 - RNA, 20 nt, Artificial Sequence
  Guide Sequence
uuucgcucgccccggccgug

SEQ ID NO: 14290 - RNA, 20 nt, Artificial Sequence
  Guide Sequence
uuucuuccucgcccuucccc

SEQ ID NO: 14291 - RNA, 21 nt, Artificial Sequence
  Guide Sequence
aaaagggguuguuccgccgug

SEQ ID NO: 14292 - RNA, 21 nt, Artificial Sequence
  Guide Sequence
aaagggguuguuccgccgugg

SEQ ID NO: 14293 - RNA, 21 nt, Artificial Sequence
  Guide Sequence
aacagccacuuccacccggaa

SEQ ID NO: 14294 - RNA, 21 nt, Artificial Sequence
  Guide Sequence
aacuuccgcccugagaagggu

SEQ ID NO: 14295 - RNA, 21 nt, Artificial Sequence
  Guide Sequence
aagaugauagccacauuucuu

SEQ ID NO: 14296 - RNA, 21 nt, Artificial Sequence
  Guide Sequence
aagcaacuuccgcccugagaa

SEQ ID NO: 14297 - RNA, 21 nt, Artificial Sequence
  Guide Sequence
aagccucagagcgcgugccug

SEQ ID NO: 14298 - RNA, 21 nt, Artificial Sequence
  Guide Sequence
aagcgggggcuccgagcugga

SEQ ID NO: 14299 - RNA, 21 nt, Artificial Sequence
  Guide Sequence
aaggacggaagaugauagcca

SEQ ID NO: 14300 - RNA, 21 nt, Artificial Sequence
  Guide Sequence
aagggguuguuccgccguggg

SEQ ID NO: 14301 - RNA, 21 nt, Artificial Sequence
  Guide Sequence
aaggguggggcuuccgucucc

SEQ ID NO: 14302 - RNA, 21 nt, Artificial Sequence
  Guide Sequence
acagccacuuccacccggaaa

SEQ ID NO: 14303 - RNA, 21 nt, Artificial Sequence
  Guide Sequence
acaguuccgcccuuacuacuc

SEQ ID NO: 14304 - RNA, 21 nt, Artificial Sequence
  Guide Sequence
acaugcccggucagcgccguc

SEQ ID NO: 14305 - RNA, 21 nt, Artificial Sequence
  Guide Sequence
acauuucuuccucgcccuucc

SEQ ID NO: 14306 - RNA, 21 nt, Artificial Sequence
  Guide Sequence
acccggaaaagggguuguucc

SEQ ID NO: 14307 - RNA, 21 nt, Artificial Sequence
  Guide Sequence
acgccgaagccucagagcgcg

SEQ ID NO: 14308 - RNA, 21 nt, Artificial Sequence
  Guide Sequence
acggaagaugauagccacauu

SEQ ID NO: 14309 - RNA, 21 nt, Artificial Sequence
  Guide Sequence
acuacucccacuuccggccag

SEQ ID NO: 14310 - RNA, 21 nt, Artificial Sequence
  Guide Sequence
acucccacuuccggccaggga

SEQ ID NO: 14311 - RNA, 21 nt, Artificial Sequence
  Guide Sequence
acuccuggcggugaaggacgg

SEQ ID NO: 14312 - RNA, 21 nt, Artificial Sequence
  Guide Sequence
acuuccacccggaaaaggggu

SEQ ID NO: 14313 - RNA, 21 nt, Artificial Sequence
  Guide Sequence
acuuccgcccugagaagggug

SEQ ID NO: 14314 - RNA, 21 nt, Artificial Sequence
  Guide Sequence
acuuccggccagggaacagcc

SEQ ID NO: 14315 - RNA, 21 nt, Artificial Sequence
  Guide Sequence
agaaggguggggcuuccgucu

SEQ ID NO: 14316 - RNA, 21 nt, Artificial Sequence
  Guide Sequence
agagccgcggccacgugcgag

SEQ ID NO: 14317 - RNA, 21 nt, Artificial Sequence
  Guide Sequence
agagcgcgugccugagggccc

SEQ ID NO: 14318 - RNA, 21 nt, Artificial Sequence
  Guide Sequence
agaugauagccacauuucuuc

SEQ ID NO: 14319 - RNA, 21 nt, Artificial Sequence
  Guide Sequence
agcaacuuccgcccugagaag

SEQ ID NO: 14320 - RNA, 21 nt, Artificial Sequence
  Guide Sequence
agccacauuucuuccucgccc

SEQ ID NO: 14321 - RNA, 21 nt, Artificial Sequence
  Guide Sequence
agccacuuccacccggaaaag

SEQ ID NO: 14322 - RNA, 21 nt, Artificial Sequence
  Guide Sequence
agccucagagcgcgugccuga

SEQ ID NO: 14323 - RNA, 21 nt, Artificial Sequence
  Guide Sequence
agcgccguccgggaaccgagc

SEQ ID NO: 14324 - RNA, 21 nt, Artificial Sequence
  Guide Sequence
agcggcaggcccggacaugcc

SEQ ID NO: 14325 - RNA, 21 nt, Artificial Sequence
  Guide Sequence
agcgggggcuccgagcuggac

SEQ ID NO: 14326 - RNA, 21 nt, Artificial Sequence
  Guide Sequence
aggacggaagaugauagccac

SEQ ID NO: 14327 - RNA, 21 nt, Artificial Sequence
  Guide Sequence
aggcccggacaugcccgguca

SEQ ID NO: 14328 - RNA, 21 nt, Artificial Sequence
  Guide Sequence
agggaacagccacuuccaccc

SEQ ID NO: 14329 - RNA, 21 nt, Artificial Sequence
  Guide Sequence
agggccggacgccgaagccuc

SEQ ID NO: 14330 - RNA, 21 nt, Artificial Sequence
  Guide Sequence
agggguuguuccgccgugggg

SEQ ID NO: 14331 - RNA, 21 nt, Artificial Sequence
  Guide Sequence
aggguggggcuuccgucuccc

SEQ ID NO: 14332 - RNA, 21 nt, Artificial Sequence
  Guide Sequence
agguucccugucacaguuccg

SEQ ID NO: 14333 - RNA, 21 nt, Artificial Sequence
  Guide Sequence
agucccggggcuggggagugg

SEQ ID NO: 14334 - RNA, 21 nt, Artificial Sequence
  Guide Sequence
aguuccgcccuuacuacuccc

SEQ ID NO: 14335 - RNA, 21 nt, Artificial Sequence
  Guide Sequence
auagccacauuucuuccucgc

SEQ ID NO: 14336 - RNA, 21 nt, Artificial Sequence
  Guide Sequence
augauagccacauuucuuccu

SEQ ID NO: 14337 - RNA, 21 nt, Artificial Sequence
  Guide Sequence
augcccggucagcgccguccg

SEQ ID NO: 14338 - RNA, 21 nt, Artificial Sequence
  Guide Sequence
auuucuuccucgcccuucccc

SEQ ID NO: 14339 - RNA, 21 nt, Artificial Sequence
  Guide Sequence
caacuuccgcccugagaaggg

SEQ ID NO: 14340 - RNA, 21 nt, Artificial Sequence
  Guide Sequence
cacaguuccgcccuuacuacu

SEQ ID NO: 14341 - RNA, 21 nt, Artificial Sequence
  Guide Sequence
cacauuucuuccucgcccuuc

SEQ ID NO: 14342 - RNA, 21 nt, Artificial Sequence
  Guide Sequence
cacccggaaaagggguuguuc

SEQ ID NO: 14343 - RNA, 21 nt, Artificial Sequence
  Guide Sequence
cacuuccacccggaaaagggg

SEQ ID NO: 14344 - RNA, 21 nt, Artificial Sequence
  Guide Sequence
cacuuccggccagggaacagc

SEQ ID NO: 14345 - RNA, 21 nt, Artificial Sequence
  Guide Sequence
cagagcgcgugccugagggcc

SEQ ID NO: 14346 - RNA, 21 nt, Artificial Sequence
  Guide Sequence
cagccacuuccacccggaaaa

SEQ ID NO: 14347 - RNA, 21 nt, Artificial Sequence
  Guide Sequence
cagcgccguccgggaaccgag

SEQ ID NO: 14348 - RNA, 21 nt, Artificial Sequence
  Guide Sequence
cagcuguggcccacccauccu

SEQ ID NO: 14349 - RNA, 21 nt, Artificial Sequence
  Guide Sequence
caggcccggacaugcccgguc

SEQ ID NO: 14350 - RNA, 21 nt, Artificial Sequence
  Guide Sequence
cagggaacagccacuuccacc

SEQ ID NO: 14351 - RNA, 21 nt, Artificial Sequence
  Guide Sequence
cagggccggacgccgaagccu

SEQ ID NO: 14352 - RNA, 21 nt, Artificial Sequence
  Guide Sequence
caguuccgcccuuacuacucc

SEQ ID NO: 14353 - RNA, 21 nt, Artificial Sequence
  Guide Sequence
caugcccggucagcgccgucc

SEQ ID NO: 14354 - RNA, 21 nt, Artificial Sequence
  Guide Sequence
cauuucuuccucgcccuuccc

SEQ ID NO: 14355 - RNA, 21 nt, Artificial Sequence
  Guide Sequence
ccacauuucuuccucgcccuu

SEQ ID NO: 14356 - RNA, 21 nt, Artificial Sequence
  Guide Sequence
ccacccggaaaagggguuguu

SEQ ID NO: 14357 - RNA, 21 nt, Artificial Sequence
  Guide Sequence
ccacuuccacccggaaaaggg

SEQ ID NO: 14358 - RNA, 21 nt, Artificial Sequence
  Guide Sequence
ccacuuccggccagggaacag

SEQ ID NO: 14359 - RNA, 21 nt, Artificial Sequence
  Guide Sequence
ccagcuguggcccacccaucc

SEQ ID NO: 14360 - RNA, 21 nt, Artificial Sequence
  Guide Sequence
ccagggaacagccacuuccac

SEQ ID NO: 14361 - RNA, 21 nt, Artificial Sequence
  Guide Sequence
cccacuuccggccagggaaca

SEQ ID NO: 14362 - RNA, 21 nt, Artificial Sequence
  Guide Sequence
ccccggccgugcugaagcaac

SEQ ID NO: 14363 - RNA, 21 nt, Artificial Sequence
  Guide Sequence
ccccuagagccgcggccacgu

SEQ ID NO: 14364 - RNA, 21 nt, Artificial Sequence
  Guide Sequence
ccccuagguucccugucacag

SEQ ID NO: 14365 - RNA, 21 nt, Artificial Sequence
  Guide Sequence
cccgcucucgcgacuccuggc

SEQ ID NO: 14366 - RNA, 21 nt, Artificial Sequence
  Guide Sequence
cccggaaaagggguuguuccg

SEQ ID NO: 14367 - RNA, 21 nt, Artificial Sequence
  Guide Sequence
cccggacaugcccggucagcg

SEQ ID NO: 14368 - RNA, 21 nt, Artificial Sequence
  Guide Sequence
cccggccgugcugaagcaacu

SEQ ID NO: 14369 - RNA, 21 nt, Artificial Sequence
  Guide Sequence
cccuagagccgcggccacgug

SEQ ID NO: 14370 - RNA, 21 nt, Artificial Sequence
  Guide Sequence
cccuagguucccugucacagu

SEQ ID NO: 14371 - RNA, 21 nt, Artificial Sequence
  Guide Sequence
cccugagaaggguggggcuuc

SEQ ID NO: 14372 - RNA, 21 nt, Artificial Sequence
  Guide Sequence
cccugucacaguuccgcccuu

SEQ ID NO: 14373 - RNA, 21 nt, Artificial Sequence
  Guide Sequence
cccuuacuacucccacuuccg

SEQ ID NO: 14374 - RNA, 21 nt, Artificial Sequence
  Guide Sequence
cccuuccccuagguucccugu

SEQ ID NO: 14375 - RNA, 21 nt, Artificial Sequence
  Guide Sequence
ccgaagccucagagcgcgugc

SEQ ID NO: 14376 - RNA, 21 nt, Artificial Sequence
  Guide Sequence
ccgcccugagaaggguggggc

SEQ ID NO: 14377 - RNA, 21 nt, Artificial Sequence
  Guide Sequence
ccgcccuuacuacucccacuu

SEQ ID NO: 14378 - RNA, 21 nt, Artificial Sequence
  Guide Sequence
ccgcucucgcgacuccuggcg

SEQ ID NO: 14379 - RNA, 21 nt, Artificial Sequence
  Guide Sequence
ccggaaaagggguuguuccgc

SEQ ID NO: 14380 - RNA, 21 nt, Artificial Sequence
  Guide Sequence
ccggacaugcccggucagcgc

SEQ ID NO: 14381 - RNA, 21 nt, Artificial Sequence
  Guide Sequence
ccggacgccgaagccucagag

SEQ ID NO: 14382 - RNA, 21 nt, Artificial Sequence
  Guide Sequence
ccggccagggaacagccacuu

SEQ ID NO: 14383 - RNA, 21 nt, Artificial Sequence
  Guide Sequence
ccggccgugcugaagcaacuu

SEQ ID NO: 14384 - RNA, 21 nt, Artificial Sequence
  Guide Sequence
ccggucagcgccguccgggaa

SEQ ID NO: 14385 - RNA, 21 nt, Artificial Sequence
  Guide Sequence
ccguccgggaaccgagcgugg

SEQ ID NO: 14386 - RNA, 21 nt, Artificial Sequence
  Guide Sequence
ccgucucccgcucucgcgacu

SEQ ID NO: 14387 - RNA, 21 nt, Artificial Sequence
  Guide Sequence
ccgugcugaagcaacuuccgc

SEQ ID NO: 14388 - RNA, 21 nt, Artificial Sequence
  Guide Sequence
ccuagagccgcggccacgugc

SEQ ID NO: 14389 - RNA, 21 nt, Artificial Sequence
  Guide Sequence
ccuagguucccugucacaguu

SEQ ID NO: 14390 - RNA, 21 nt, Artificial Sequence
  Guide Sequence
ccucagagcgcgugccugagg

SEQ ID NO: 14391 - RNA, 21 nt, Artificial Sequence
  Guide Sequence
ccucgcccuuccccuagguuc

SEQ ID NO: 14392 - RNA, 21 nt, Artificial Sequence
  Guide Sequence
ccugagaaggguggggcuucc

SEQ ID NO: 14393 - RNA, 21 nt, Artificial Sequence
  Guide Sequence
ccuggcggugaaggacggaag

SEQ ID NO: 14394 - RNA, 21 nt, Artificial Sequence
  Guide Sequence
ccugucacaguuccgcccuua

SEQ ID NO: 14395 - RNA, 21 nt, Artificial Sequence
  Guide Sequence
ccuuacuacucccacuuccgg

SEQ ID NO: 14396 - RNA, 21 nt, Artificial Sequence
  Guide Sequence
ccuuccccuagguucccuguc

SEQ ID NO: 14397 - RNA, 21 nt, Artificial Sequence
  Guide Sequence
cgaagccucagagcgcgugcc

SEQ ID NO: 14398 - RNA, 21 nt, Artificial Sequence
  Guide Sequence
cgacuccuggcggugaaggac

SEQ ID NO: 14399 - RNA, 21 nt, Artificial Sequence
  Guide Sequence
cgagcggcaggcccggacaug

SEQ ID NO: 14400 - RNA, 21 nt, Artificial Sequence
  Guide Sequence
cgccagcuguggcccacccau

SEQ ID NO: 14401 - RNA, 21 nt, Artificial Sequence
  Guide Sequence
cgccccggccgugcugaagca

SEQ ID NO: 14402 - RNA, 21 nt, Artificial Sequence
  Guide Sequence
cgcccugagaaggguggggcu

SEQ ID NO: 14403 - RNA, 21 nt, Artificial Sequence
  Guide Sequence
cgcccuuacuacucccacuuc

SEQ ID NO: 14404 - RNA, 21 nt, Artificial Sequence
  Guide Sequence
cgcccuuccccuagguucccu

SEQ ID NO: 14405 - RNA, 21 nt, Artificial Sequence
  Guide Sequence
cgccgaagccucagagcgcgu

SEQ ID NO: 14406 - RNA, 21 nt, Artificial Sequence
  Guide Sequence
cgccguccgggaaccgagcgu

SEQ ID NO: 14407 - RNA, 21 nt, Artificial Sequence
  Guide Sequence
cgcgacuccuggcggugaagg

SEQ ID NO: 14408 - RNA, 21 nt, Artificial Sequence
  Guide Sequence
cgcucucgcgacuccuggcgg

SEQ ID NO: 14409 - RNA, 21 nt, Artificial Sequence
  Guide Sequence
cggaaaagggguuguuccgcc

SEQ ID NO: 14410 - RNA, 21 nt, Artificial Sequence
  Guide Sequence
cggaagaugauagccacauuu

SEQ ID NO: 14411 - RNA, 21 nt, Artificial Sequence
  Guide Sequence
cggacaugcccggucagcgcc

SEQ ID NO: 14412 - RNA, 21 nt, Artificial Sequence
  Guide Sequence
cggacgccgaagccucagagc

SEQ ID NO: 14413 - RNA, 21 nt, Artificial Sequence
  Guide Sequence
cggccagggaacagccacuuc

SEQ ID NO: 14414 - RNA, 21 nt, Artificial Sequence
  Guide Sequence
cggccgugcugaagcaacuuc

SEQ ID NO: 14415 - RNA, 21 nt, Artificial Sequence
  Guide Sequence
cggucagcgccguccgggaac

SEQ ID NO: 14416 - RNA, 21 nt, Artificial Sequence
  Guide Sequence
cggugaaggacggaagaugau

SEQ ID NO: 14417 - RNA, 21 nt, Artificial Sequence
  Guide Sequence
cguccgggaaccgagcguggg

SEQ ID NO: 14418 - RNA, 21 nt, Artificial Sequence
  Guide Sequence
cgucucccgcucucgcgacuc

SEQ ID NO: 14419 - RNA, 21 nt, Artificial Sequence
  Guide Sequence
cgugcugaagcaacuuccgcc

SEQ ID NO: 14420 - RNA, 21 nt, Artificial Sequence
  Guide Sequence
cuacucccacuuccggccagg

SEQ ID NO: 14421 - RNA, 21 nt, Artificial Sequence
  Guide Sequence
cuagagccgcggccacgugcg

SEQ ID NO: 14422 - RNA, 21 nt, Artificial Sequence
  Guide Sequence
cuagguucccugucacaguuc

SEQ ID NO: 14423 - RNA, 21 nt, Artificial Sequence
  Guide Sequence
cucagagcgcgugccugaggg

SEQ ID NO: 14424 - RNA, 21 nt, Artificial Sequence
  Guide Sequence
cucccacuuccggccagggaa

SEQ ID NO: 14425 - RNA, 21 nt, Artificial Sequence
  Guide Sequence
cucccgcucucgcgacuccug

SEQ ID NO: 14426 - RNA, 21 nt, Artificial Sequence
  Guide Sequence
cuccuggcggugaaggacgga

SEQ ID NO: 14427 - RNA, 21 nt, Artificial Sequence
  Guide Sequence
cucgccccggccgugcugaag

SEQ ID NO: 14428 - RNA, 21 nt, Artificial Sequence
  Guide Sequence
cucgcccuuccccuagguucc

SEQ ID NO: 14429 - RNA, 21 nt, Artificial Sequence
  Guide Sequence
cucgcgacuccuggcggugaa

SEQ ID NO: 14430 - RNA, 21 nt, Artificial Sequence
  Guide Sequence
cucucgcgacuccuggcggug

SEQ ID NO: 14431 - RNA, 21 nt, Artificial Sequence
  Guide Sequence
cugaagcaacuuccgcccuga

SEQ ID NO: 14432 - RNA, 21 nt, Artificial Sequence
  Guide Sequence
cugagaaggguggggcuuccg

SEQ ID NO: 14433 - RNA, 21 nt, Artificial Sequence
  Guide Sequence
cuggcggugaaggacggaaga

SEQ ID NO: 14434 - RNA, 21 nt, Artificial Sequence
  Guide Sequence
cugucacaguuccgcccuuac

SEQ ID NO: 14435 - RNA, 21 nt, Artificial Sequence
  Guide Sequence
cuuacuacucccacuuccggc

SEQ ID NO: 14436 - RNA, 21 nt, Artificial Sequence
  Guide Sequence
cuuccacccggaaaagggguu

SEQ ID NO: 14437 - RNA, 21 nt, Artificial Sequence
  Guide Sequence
cuuccccuagguucccuguca

SEQ ID NO: 14438 - RNA, 21 nt, Artificial Sequence
  Guide Sequence
cuuccgcccugagaagggugg

SEQ ID NO: 14439 - RNA, 21 nt, Artificial Sequence
  Guide Sequence
cuuccggccagggaacagcca

SEQ ID NO: 14440 - RNA, 21 nt, Artificial Sequence
  Guide Sequence
cuuccgucucccgcucucgcg

SEQ ID NO: 14441 - RNA, 21 nt, Artificial Sequence
  Guide Sequence
cuuccucgcccuuccccuagg

SEQ ID NO: 14442 - RNA, 21 nt, Artificial Sequence
  Guide Sequence
gaaaagggguuguuccgccgu

SEQ ID NO: 14443 - RNA, 21 nt, Artificial Sequence
  Guide Sequence
gaacagccacuuccacccgga

SEQ ID NO: 14444 - RNA, 21 nt, Artificial Sequence
  Guide Sequence
gaagaugauagccacauuucu

SEQ ID NO: 14445 - RNA, 21 nt, Artificial Sequence
  Guide Sequence
gaagcaacuuccgcccugaga

SEQ ID NO: 14446 - RNA, 21 nt, Artificial Sequence
  Guide Sequence
gaagccucagagcgcgugccu

SEQ ID NO: 14447 - RNA, 21 nt, Artificial Sequence
  Guide Sequence
gaaggacggaagaugauagcc

SEQ ID NO: 14448 - RNA, 21 nt, Artificial Sequence
  Guide Sequence
gaaggguggggcuuccgucuc

SEQ ID NO: 14449 - RNA, 21 nt, Artificial Sequence
  Guide Sequence
gacaugcccggucagcgccgu

SEQ ID NO: 14450 - RNA, 21 nt, Artificial Sequence
  Guide Sequence
gacgccgaagccucagagcgc

SEQ ID NO: 14451 - RNA, 21 nt, Artificial Sequence
  Guide Sequence
gacggaagaugauagccacau

SEQ ID NO: 14452 - RNA, 21 nt, Artificial Sequence
  Guide Sequence
gacuccuggcggugaaggacg

SEQ ID NO: 14453 - RNA, 21 nt, Artificial Sequence
  Guide Sequence
gagaaggguggggcuuccguc

SEQ ID NO: 14454 - RNA, 21 nt, Artificial Sequence
  Guide Sequence
gagcggcaggcccggacaugc

SEQ ID NO: 14455 - RNA, 21 nt, Artificial Sequence
  Guide Sequence
gagucccggggcuggggagug

SEQ ID NO: 14456 - RNA, 21 nt, Artificial Sequence
  Guide Sequence
gauagccacauuucuuccucg

SEQ ID NO: 14457 - RNA, 21 nt, Artificial Sequence
  Guide Sequence
gaugauagccacauuucuucc

SEQ ID NO: 14458 - RNA, 21 nt, Artificial Sequence
  Guide Sequence
gcaacuuccgcccugagaagg

SEQ ID NO: 14459 - RNA, 21 nt, Artificial Sequence
  Guide Sequence
gcaggcccggacaugcccggu

SEQ ID NO: 14460 - RNA, 21 nt, Artificial Sequence
  Guide Sequence
gccacauuucuuccucgcccu

SEQ ID NO: 14461 - RNA, 21 nt, Artificial Sequence
  Guide Sequence
gccacuuccacccggaaaagg

SEQ ID NO: 14462 - RNA, 21 nt, Artificial Sequence
  Guide Sequence
gccagcuguggcccacccauc

SEQ ID NO: 14463 - RNA, 21 nt, Artificial Sequence
  Guide Sequence
gccagggaacagccacuucca

SEQ ID NO: 14464 - RNA, 21 nt, Artificial Sequence
  Guide Sequence
gccccggccgugcugaagcaa

SEQ ID NO: 14465 - RNA, 21 nt, Artificial Sequence
  Guide Sequence
gcccggacaugcccggucagc

SEQ ID NO: 14466 - RNA, 21 nt, Artificial Sequence
  Guide Sequence
gcccugagaaggguggggcuu

SEQ ID NO: 14467 - RNA, 21 nt, Artificial Sequence
  Guide Sequence
gcccuuacuacucccacuucc

SEQ ID NO: 14468 - RNA, 21 nt, Artificial Sequence
  Guide Sequence
gcccuuccccuagguucccug

SEQ ID NO: 14469 - RNA, 21 nt, Artificial Sequence
  Guide Sequence
gccgaagccucagagcgcgug

SEQ ID NO: 14470 - RNA, 21 nt, Artificial Sequence
  Guide Sequence
gccggacgccgaagccucaga

SEQ ID NO: 14471 - RNA, 21 nt, Artificial Sequence
  Guide Sequence
gccguccgggaaccgagcgug

SEQ ID NO: 14472 - RNA, 21 nt, Artificial Sequence
  Guide Sequence
gccgugcugaagcaacuuccg

SEQ ID NO: 14473 - RNA, 21 nt, Artificial Sequence
  Guide Sequence
gccucagagcgcgugccugag

SEQ ID NO: 14474 - RNA, 21 nt, Artificial Sequence
  Guide Sequence
gcgacuccuggcggugaagga

SEQ ID NO: 14475 - RNA, 21 nt, Artificial Sequence
  Guide Sequence
gcgagcggcaggcccggacau

SEQ ID NO: 14476 - RNA, 21 nt, Artificial Sequence
  Guide Sequence
gcgccagcuguggcccaccca

SEQ ID NO: 14477 - RNA, 21 nt, Artificial Sequence
  Guide Sequence
gcggugaaggacggaagauga

SEQ ID NO: 14478 - RNA, 21 nt, Artificial Sequence
  Guide Sequence
gcucgccccggccgugcugaa

SEQ ID NO: 14479 - RNA, 21 nt, Artificial Sequence
  Guide Sequence
gcucucgcgacuccuggcggu

SEQ ID NO: 14480 - RNA, 21 nt, Artificial Sequence
  Guide Sequence
gcugaagcaacuuccgcccug

SEQ ID NO: 14481 - RNA, 21 nt, Artificial Sequence
  Guide Sequence
gcuuccgucucccgcucucgc

SEQ ID NO: 14482 - RNA, 21 nt, Artificial Sequence
  Guide Sequence
ggaaaagggguuguuccgccg

SEQ ID NO: 14483 - RNA, 21 nt, Artificial Sequence
  Guide Sequence
ggaacagccacuuccacccgg

SEQ ID NO: 14484 - RNA, 21 nt, Artificial Sequence
  Guide Sequence
ggaagaugauagccacauuuc

SEQ ID NO: 14485 - RNA, 21 nt, Artificial Sequence
  Guide Sequence
ggacaugcccggucagcgccg

SEQ ID NO: 14486 - RNA, 21 nt, Artificial Sequence
  Guide Sequence
ggacgccgaagccucagagcg

SEQ ID NO: 14487 - RNA, 21 nt, Artificial Sequence
  Guide Sequence
ggacggaagaugauagccaca

SEQ ID NO: 14488 - RNA, 21 nt, Artificial Sequence
  Guide Sequence
ggagucccggggcuggggagu

SEQ ID NO: 14489 - RNA, 21 nt, Artificial Sequence
  Guide Sequence
ggccagggaacagccacuucc

SEQ ID NO: 14490 - RNA, 21 nt, Artificial Sequence
  Guide Sequence
ggcccggacaugcccggucag

SEQ ID NO: 14491 - RNA, 21 nt, Artificial Sequence
  Guide Sequence
ggccggacgccgaagccucag

SEQ ID NO: 14492 - RNA, 21 nt, Artificial Sequence
  Guide Sequence
ggccgugcugaagcaacuucc

SEQ ID NO: 14493 - RNA, 21 nt, Artificial Sequence
  Guide Sequence
ggcggugaaggacggaagaug

SEQ ID NO: 14494 - RNA, 21 nt, Artificial Sequence
  Guide Sequence
ggcuuccgucucccgcucucg

SEQ ID NO: 14495 - RNA, 21 nt, Artificial Sequence
  Guide Sequence
gggaacagccacuuccacccg

SEQ ID NO: 14496 - RNA, 21 nt, Artificial Sequence
  Guide Sequence
gggccggacgccgaagccuca

SEQ ID NO: 14497 - RNA, 21 nt, Artificial Sequence
  Guide Sequence
gggcuuccgucucccgcucuc

SEQ ID NO: 14498 - RNA, 21 nt, Artificial Sequence
  Guide Sequence
ggggcuuccgucucccgcucu

SEQ ID NO: 14499 - RNA, 21 nt, Artificial Sequence
  Guide Sequence
gggguuguuccgccguggggc

SEQ ID NO: 14500 - RNA, 21 nt, Artificial Sequence
  Guide Sequence
ggguggggcuuccgucucccg

SEQ ID NO: 14501 - RNA, 21 nt, Artificial Sequence
  Guide Sequence
ggguuguuccgccguggggcg

SEQ ID NO: 14502 - RNA, 21 nt, Artificial Sequence
  Guide Sequence
gguaagcgggggcuccgagcu

SEQ ID NO: 14503 - RNA, 21 nt, Artificial Sequence
  Guide Sequence
ggucagcgccguccgggaacc

SEQ ID NO: 14504 - RNA, 21 nt, Artificial Sequence
  Guide Sequence
ggugaaggacggaagaugaua

SEQ ID NO: 14505 - RNA, 21 nt, Artificial Sequence
  Guide Sequence
ggugcguggggcguccggagu

SEQ ID NO: 14506 - RNA, 21 nt, Artificial Sequence
  Guide Sequence
gguggggcuuccgucucccgc

SEQ ID NO: 14507 - RNA, 21 nt, Artificial Sequence
  Guide Sequence
gguucccugucacaguuccgc

SEQ ID NO: 14508 - RNA, 21 nt, Artificial Sequence
  Guide Sequence
gguuguuccgccguggggcgc

SEQ ID NO: 14509 - RNA, 21 nt, Artificial Sequence
  Guide Sequence
guaagcgggggcuccgagcug

SEQ ID NO: 14510 - RNA, 21 nt, Artificial Sequence
  Guide Sequence
gucacaguuccgcccuuacua

SEQ ID NO: 14511 - RNA, 21 nt, Artificial Sequence
  Guide Sequence
gucagcgccguccgggaaccg

SEQ ID NO: 14512 - RNA, 21 nt, Artificial Sequence
  Guide Sequence
guccgggaaccgagcgugggc

SEQ ID NO: 14513 - RNA, 21 nt, Artificial Sequence
  Guide Sequence
gucucccgcucucgcgacucc

SEQ ID NO: 14514 - RNA, 21 nt, Artificial Sequence
  Guide Sequence
gugaaggacggaagaugauag

SEQ ID NO: 14515 - RNA, 21 nt, Artificial Sequence
  Guide Sequence
gugcguggggcguccggaguc

SEQ ID NO: 14516 - RNA, 21 nt, Artificial Sequence
  Guide Sequence
gugcugaagcaacuuccgccc

SEQ ID NO: 14517 - RNA, 21 nt, Artificial Sequence
  Guide Sequence
guggggcuuccgucucccgcu

SEQ ID NO: 14518 - RNA, 21 nt, Artificial Sequence
  Guide Sequence
guucccugucacaguuccgcc

SEQ ID NO: 14519 - RNA, 21 nt, Artificial Sequence
  Guide Sequence
guuccgcccuuacuacuccca

SEQ ID NO: 14520 - RNA, 21 nt, Artificial Sequence
  Guide Sequence
guuguuccgccguggggcgcc

SEQ ID NO: 14521 - RNA, 21 nt, Artificial Sequence
  Guide Sequence
uaagcgggggcuccgagcugg

SEQ ID NO: 14522 - RNA, 21 nt, Artificial Sequence
  Guide Sequence
uacuacucccacuuccggcca

SEQ ID NO: 14523 - RNA, 21 nt, Artificial Sequence
  Guide Sequence
uacucccacuuccggccaggg

SEQ ID NO: 14524 - RNA, 21 nt, Artificial Sequence
  Guide Sequence
uagagccgcggccacgugcga

SEQ ID NO: 14525 - RNA, 21 nt, Artificial Sequence
  Guide Sequence
uagccacauuucuuccucgcc

SEQ ID NO: 14526 - RNA, 21 nt, Artificial Sequence
  Guide Sequence
uagguucccugucacaguucc

SEQ ID NO: 14527 - RNA, 21 nt, Artificial Sequence
  Guide Sequence
ucacaguuccgcccuuacuac

SEQ ID NO: 14528 - RNA, 21 nt, Artificial Sequence
  Guide Sequence
ucagagcgcgugccugagggc

SEQ ID NO: 14529 - RNA, 21 nt, Artificial Sequence
  Guide Sequence
ucagcgccguccgggaaccga

SEQ ID NO: 14530 - RNA, 21 nt, Artificial Sequence
  Guide Sequence
uccacccggaaaagggguugu

SEQ ID NO: 14531 - RNA, 21 nt, Artificial Sequence
  Guide Sequence
ucccacuuccggccagggaac

SEQ ID NO: 14532 - RNA, 21 nt, Artificial Sequence
  Guide Sequence
uccccuagguucccugucaca

SEQ ID NO: 14533 - RNA, 21 nt, Artificial Sequence
  Guide Sequence
ucccgcucucgcgacuccugg

SEQ ID NO: 14534 - RNA, 21 nt, Artificial Sequence
  Guide Sequence
ucccugucacaguuccgcccu

SEQ ID NO: 14535 - RNA, 21 nt, Artificial Sequence
  Guide Sequence
uccgcccugagaagggugggg

SEQ ID NO: 14536 - RNA, 21 nt, Artificial Sequence
  Guide Sequence
uccgcccuuacuacucccacu

SEQ ID NO: 14537 - RNA, 21 nt, Artificial Sequence
  Guide Sequence
uccggccagggaacagccacu

SEQ ID NO: 14538 - RNA, 21 nt, Artificial Sequence
  Guide Sequence
uccgggaaccgagcgugggcc

SEQ ID NO: 14539 - RNA, 21 nt, Artificial Sequence
  Guide Sequence
uccgucucccgcucucgcgac

SEQ ID NO: 14540 - RNA, 21 nt, Artificial Sequence
  Guide Sequence
uccucgcccuuccccuagguu

SEQ ID NO: 14541 - RNA, 21 nt, Artificial Sequence
  Guide Sequence
uccuggcggugaaggacggaa

SEQ ID NO: 14542 - RNA, 21 nt, Artificial Sequence
  Guide Sequence
ucgccccggccgugcugaagc

SEQ ID NO: 14543 - RNA, 21 nt, Artificial Sequence
  Guide Sequence
ucgcccuuccccuagguuccc

SEQ ID NO: 14544 - RNA, 21 nt, Artificial Sequence
  Guide Sequence
ucgcgacuccuggcggugaag

SEQ ID NO: 14545 - RNA, 21 nt, Artificial Sequence
  Guide Sequence
ucucccgcucucgcgacuccu

SEQ ID NO: 14546 - RNA, 21 nt, Artificial Sequence
  Guide Sequence
ucucgcgacuccuggcgguga

SEQ ID NO: 14547 - RNA, 21 nt, Artificial Sequence
  Guide Sequence
ucuuccucgcccuuccccuag

SEQ ID NO: 14548 - RNA, 21 nt, Artificial Sequence
  Guide Sequence
ugaagcaacuuccgcccugag

SEQ ID NO: 14549 - RNA, 21 nt, Artificial Sequence
  Guide Sequence
ugaaggacggaagaugauagc

SEQ ID NO: 14550 - RNA, 21 nt, Artificial Sequence
  Guide Sequence
ugagaaggguggggcuuccgu

SEQ ID NO: 14551 - RNA, 21 nt, Artificial Sequence
  Guide Sequence
ugauagccacauuucuuccuc

SEQ ID NO: 14552 - RNA, 21 nt, Artificial Sequence
  Guide Sequence
ugcgagcggcaggcccggaca

SEQ ID NO: 14553 - RNA, 21 nt, Artificial Sequence
  Guide Sequence
ugcguggggcguccggagucc

SEQ ID NO: 14554 - RNA, 21 nt, Artificial Sequence
  Guide Sequence
ugcugaagcaacuuccgcccu

SEQ ID NO: 14555 - RNA, 21 nt, Artificial Sequence
  Guide Sequence
uggcggugaaggacggaagau

SEQ ID NO: 14556 - RNA, 21 nt, Artificial Sequence
  Guide Sequence
uggggcgccagcuguggccca

SEQ ID NO: 14557 - RNA, 21 nt, Artificial Sequence
  Guide Sequence
uggggcuuccgucucccgcuc

SEQ ID NO: 14558 - RNA, 21 nt, Artificial Sequence
  Guide Sequence
ugucacaguuccgcccuuacu

SEQ ID NO: 14559 - RNA, 21 nt, Artificial Sequence
  Guide Sequence
uguuccgccguggggcgccag

SEQ ID NO: 14560 - RNA, 21 nt, Artificial Sequence
  Guide Sequence
uuacuacucccacuuccggcc

SEQ ID NO: 14561 - RNA, 21 nt, Artificial Sequence
  Guide Sequence
uuccacccggaaaagggguug

SEQ ID NO: 14562 - RNA, 21 nt, Artificial Sequence
  Guide Sequence
uuccccuagguucccugucac

SEQ ID NO: 14563 - RNA, 21 nt, Artificial Sequence
  Guide Sequence
uucccugucacaguuccgccc

SEQ ID NO: 14564 - RNA, 21 nt, Artificial Sequence
  Guide Sequence
uuccgcccugagaaggguggg

SEQ ID NO: 14565 - RNA, 21 nt, Artificial Sequence
  Guide Sequence
uuccgcccuuacuacucccac

SEQ ID NO: 14566 - RNA, 21 nt, Artificial Sequence
  Guide Sequence
uuccgccguggggcgccagcu

SEQ ID NO: 14567 - RNA, 21 nt, Artificial Sequence
  Guide Sequence
uuccggccagggaacagccac

SEQ ID NO: 14568 - RNA, 21 nt, Artificial Sequence
  Guide Sequence
uuccgucucccgcucucgcga

SEQ ID NO: 14569 - RNA, 21 nt, Artificial Sequence
  Guide Sequence
uuccucgcccuuccccuaggu

SEQ ID NO: 14570 - RNA, 21 nt, Artificial Sequence
  Guide Sequence
uucgcucgccccggccgugcu

SEQ ID NO: 14571 - RNA, 21 nt, Artificial Sequence
  Guide Sequence
uucuuccucgcccuuccccua

SEQ ID NO: 14572 - RNA, 21 nt, Artificial Sequence
  Guide Sequence
uuguuccgccguggggcgcca

SEQ ID NO: 14573 - RNA, 21 nt, Artificial Sequence
  Guide Sequence
uuucgcucgccccggccgugc

SEQ ID NO: 14574 - RNA, 21 nt, Artificial Sequence
  Guide Sequence
uuucuuccucgcccuuccccu

SEQ ID NO: 14575 - RNA, 22 nt, Artificial Sequence
  Guide Sequence
aaaagggguuguuccgccgugg

SEQ ID NO: 14576 - RNA, 22 nt, Artificial Sequence
  Guide Sequence
aaagggguuguuccgccguggg

SEQ ID NO: 14577 - RNA, 22 nt, Artificial Sequence
  Guide Sequence
aacagccacuuccacccggaaa

SEQ ID NO: 14578 - RNA, 22 nt, Artificial Sequence
  Guide Sequence
aacuuccgcccugagaagggug

SEQ ID NO: 14579 - RNA, 22 nt, Artificial Sequence
  Guide Sequence
aagaugauagccacauuucuuc

SEQ ID NO: 14580 - RNA, 22 nt, Artificial Sequence
  Guide Sequence
aagcaacuuccgcccugagaag

SEQ ID NO: 14581 - RNA, 22 nt, Artificial Sequence
  Guide Sequence
aagccucagagcgcgugccuga

SEQ ID NO: 14582 - RNA, 22 nt, Artificial Sequence
  Guide Sequence
aagcgggggcuccgagcuggac

SEQ ID NO: 14583 - RNA, 22 nt, Artificial Sequence
  Guide Sequence
aaggacggaagaugauagccac

SEQ ID NO: 14584 - RNA, 22 nt, Artificial Sequence
  Guide Sequence
aagggguuguuccgccgugggg

SEQ ID NO: 14585 - RNA, 22 nt, Artificial Sequence
  Guide Sequence
aaggguggggcuuccgucuccc

SEQ ID NO: 14586 - RNA, 22 nt, Artificial Sequence
  Guide Sequence
acagccacuuccacccggaaaa

SEQ ID NO: 14587 - RNA, 22 nt, Artificial Sequence
  Guide Sequence
acaguuccgcccuuacuacucc

SEQ ID NO: 14588 - RNA, 22 nt, Artificial Sequence
  Guide Sequence
acaugcccggucagcgccgucc

SEQ ID NO: 14589 - RNA, 22 nt, Artificial Sequence
  Guide Sequence
acauuucuuccucgcccuuccc

SEQ ID NO: 14590 - RNA, 22 nt, Artificial Sequence
  Guide Sequence
acccggaaaagggguuguuccg

SEQ ID NO: 14591 - RNA, 22 nt, Artificial Sequence
  Guide Sequence
acgccgaagccucagagcgcgu

SEQ ID NO: 14592 - RNA, 22 nt, Artificial Sequence
  Guide Sequence
acggaagaugauagccacauuu

SEQ ID NO: 14593 - RNA, 22 nt, Artificial Sequence
  Guide Sequence
acgugcgagcggcaggcccgga

SEQ ID NO: 14594 - RNA, 22 nt, Artificial Sequence
  Guide Sequence
acuacucccacuuccggccagg

SEQ ID NO: 14595 - RNA, 22 nt, Artificial Sequence
  Guide Sequence
acucccacuuccggccagggaa

SEQ ID NO: 14596 - RNA, 22 nt, Artificial Sequence
  Guide Sequence
acuccuggcggugaaggacgga

SEQ ID NO: 14597 - RNA, 22 nt, Artificial Sequence
  Guide Sequence
acuuccacccggaaaagggguu

SEQ ID NO: 14598 - RNA, 22 nt, Artificial Sequence
  Guide Sequence
acuuccgcccugagaagggugg

SEQ ID NO: 14599 - RNA, 22 nt, Artificial Sequence
  Guide Sequence
acuuccggccagggaacagcca

SEQ ID NO: 14600 - RNA, 22 nt, Artificial Sequence
  Guide Sequence
agaaggguggggcuuccgucuc

SEQ ID NO: 14601 - RNA, 22 nt, Artificial Sequence
  Guide Sequence
agagccgcggccacgugcgagc

SEQ ID NO: 14602 - RNA, 22 nt, Artificial Sequence
  Guide Sequence
agagcgcgugccugagggcccc

SEQ ID NO: 14603 - RNA, 22 nt, Artificial Sequence
  Guide Sequence
agaugauagccacauuucuucc

SEQ ID NO: 14604 - RNA, 22 nt, Artificial Sequence
  Guide Sequence
agcaacuuccgcccugagaagg

SEQ ID NO: 14605 - RNA, 22 nt, Artificial Sequence
  Guide Sequence
agccacauuucuuccucgcccu

SEQ ID NO: 14606 - RNA, 22 nt, Artificial Sequence
  Guide Sequence
agccacuuccacccggaaaagg

SEQ ID NO: 14607 - RNA, 22 nt, Artificial Sequence
  Guide Sequence
agccucagagcgcgugccugag

SEQ ID NO: 14608 - RNA, 22 nt, Artificial Sequence
  Guide Sequence
agcgccguccgggaaccgagcg

SEQ ID NO: 14609 - RNA, 22 nt, Artificial Sequence
  Guide Sequence
agcgcgugccugagggccccga

SEQ ID NO: 14610 - RNA, 22 nt, Artificial Sequence
  Guide Sequence
agcggcaggcccggacaugccc

SEQ ID NO: 14611 - RNA, 22 nt, Artificial Sequence
  Guide Sequence
agcgggggcuccgagcuggacc

SEQ ID NO: 14612 - RNA, 22 nt, Artificial Sequence
  Guide Sequence
aggacggaagaugauagccaca

SEQ ID NO: 14613 - RNA, 22 nt, Artificial Sequence
  Guide Sequence
aggcccggacaugcccggucag

SEQ ID NO: 14614 - RNA, 22 nt, Artificial Sequence
  Guide Sequence
agggaacagccacuuccacccg

SEQ ID NO: 14615 - RNA, 22 nt, Artificial Sequence
  Guide Sequence
agggccggacgccgaagccuca

SEQ ID NO: 14616 - RNA, 22 nt, Artificial Sequence
  Guide Sequence
agggguuguuccgccguggggc

SEQ ID NO: 14617 - RNA, 22 nt, Artificial Sequence
  Guide Sequence
aggguggggcuuccgucucccg

SEQ ID NO: 14618 - RNA, 22 nt, Artificial Sequence
  Guide Sequence
agguucccugucacaguuccgc

SEQ ID NO: 14619 - RNA, 22 nt, Artificial Sequence
  Guide Sequence
agucccggggcuggggaguggg

SEQ ID NO: 14620 - RNA, 22 nt, Artificial Sequence
  Guide Sequence
aguuccgcccuuacuacuccca

SEQ ID NO: 14621 - RNA, 22 nt, Artificial Sequence
  Guide Sequence
auagccacauuucuuccucgcc

SEQ ID NO: 14622 - RNA, 22 nt, Artificial Sequence
  Guide Sequence
augauagccacauuucuuccuc

SEQ ID NO: 14623 - RNA, 22 nt, Artificial Sequence
  Guide Sequence
augcccggucagcgccguccgg

SEQ ID NO: 14624 - RNA, 22 nt, Artificial Sequence
  Guide Sequence
auuucuuccucgcccuuccccu

SEQ ID NO: 14625 - RNA, 22 nt, Artificial Sequence
  Guide Sequence
caacuuccgcccugagaagggu

SEQ ID NO: 14626 - RNA, 22 nt, Artificial Sequence
  Guide Sequence
cacaguuccgcccuuacuacuc

SEQ ID NO: 14627 - RNA, 22 nt, Artificial Sequence
  Guide Sequence
cacauuucuuccucgcccuucc

SEQ ID NO: 14628 - RNA, 22 nt, Artificial Sequence
  Guide Sequence
cacccggaaaagggguuguucc

SEQ ID NO: 14629 - RNA, 22 nt, Artificial Sequence
  Guide Sequence
cacuuccacccggaaaaggggu

SEQ ID NO: 14630 - RNA, 22 nt, Artificial Sequence
  Guide Sequence
cacuuccggccagggaacagcc

SEQ ID NO: 14631 - RNA, 22 nt, Artificial Sequence
  Guide Sequence
cagagcgcgugccugagggccc

SEQ ID NO: 14632 - RNA, 22 nt, Artificial Sequence
  Guide Sequence
cagccacuuccacccggaaaag

SEQ ID NO: 14633 - RNA, 22 nt, Artificial Sequence
  Guide Sequence
cagcgccguccgggaaccgagc

SEQ ID NO: 14634 - RNA, 22 nt, Artificial Sequence
  Guide Sequence
caggcccggacaugcccgguca

SEQ ID NO: 14635 - RNA, 22 nt, Artificial Sequence
  Guide Sequence
cagggaacagccacuuccaccc

SEQ ID NO: 14636 - RNA, 22 nt, Artificial Sequence
  Guide Sequence
cagggccggacgccgaagccuc

SEQ ID NO: 14637 - RNA, 22 nt, Artificial Sequence
  Guide Sequence
caguuccgcccuuacuacuccc

SEQ ID NO: 14638 - RNA, 22 nt, Artificial Sequence
  Guide Sequence
caugcccggucagcgccguccg

SEQ ID NO: 14639 - RNA, 22 nt, Artificial Sequence
  Guide Sequence
cauuucuuccucgcccuucccc

SEQ ID NO: 14640 - RNA, 22 nt, Artificial Sequence
  Guide Sequence
ccacauuucuuccucgcccuuc

SEQ ID NO: 14641 - RNA, 22 nt, Artificial Sequence
  Guide Sequence
ccacccggaaaagggguuguuc

SEQ ID NO: 14642 - RNA, 22 nt, Artificial Sequence
  Guide Sequence
ccacuuccacccggaaaagggg

SEQ ID NO: 14643 - RNA, 22 nt, Artificial Sequence
  Guide Sequence
ccacuuccggccagggaacagc

SEQ ID NO: 14644 - RNA, 22 nt, Artificial Sequence
  Guide Sequence
ccagcuguggcccacccauccu

SEQ ID NO: 14645 - RNA, 22 nt, Artificial Sequence
  Guide Sequence
ccagggaacagccacuuccacc

SEQ ID NO: 14646 - RNA, 22 nt, Artificial Sequence
  Guide Sequence
cccacuuccggccagggaacag

SEQ ID NO: 14647 - RNA, 22 nt, Artificial Sequence
  Guide Sequence
cccccuagagccgcggccacgu

SEQ ID NO: 14648 - RNA, 22 nt, Artificial Sequence
  Guide Sequence
ccccggccgugcugaagcaacu

SEQ ID NO: 14649 - RNA, 22 nt, Artificial Sequence
  Guide Sequence
ccccuagagccgcggccacgug

SEQ ID NO: 14650 - RNA, 22 nt, Artificial Sequence
  Guide Sequence
ccccuagguucccugucacagu

SEQ ID NO: 14651 - RNA, 22 nt, Artificial Sequence
  Guide Sequence
cccgcucucgcgacuccuggcg

SEQ ID NO: 14652 - RNA, 22 nt, Artificial Sequence
  Guide Sequence
cccggaaaagggguuguuccgc

SEQ ID NO: 14653 - RNA, 22 nt, Artificial Sequence
  Guide Sequence
cccggacaugcccggucagcgc

SEQ ID NO: 14654 - RNA, 22 nt, Artificial Sequence
  Guide Sequence
cccggccgugcugaagcaacuu

SEQ ID NO: 14655 - RNA, 22 nt, Artificial Sequence
  Guide Sequence
cccggucagcgccguccgggaa

SEQ ID NO: 14656 - RNA, 22 nt, Artificial Sequence
  Guide Sequence
cccuagagccgcggccacgugc

SEQ ID NO: 14657 - RNA, 22 nt, Artificial Sequence
  Guide Sequence
cccuagguucccugucacaguu

SEQ ID NO: 14658 - RNA, 22 nt, Artificial Sequence
  Guide Sequence
cccugagaaggguggggcuucc

SEQ ID NO: 14659 - RNA, 22 nt, Artificial Sequence
  Guide Sequence
cccugucacaguuccgcccuua

SEQ ID NO: 14660 - RNA, 22 nt, Artificial Sequence
  Guide Sequence
cccuuacuacucccacuuccgg

SEQ ID NO: 14661 - RNA, 22 nt, Artificial Sequence
  Guide Sequence
cccuuccccuagguucccuguc

SEQ ID NO: 14662 - RNA, 22 nt, Artificial Sequence
  Guide Sequence
ccgaagccucagagcgcgugcc

SEQ ID NO: 14663 - RNA, 22 nt, Artificial Sequence
  Guide Sequence
ccgcccugagaaggguggggcu

SEQ ID NO: 14664 - RNA, 22 nt, Artificial Sequence
  Guide Sequence
ccgcccuuacuacucccacuuc

SEQ ID NO: 14665 - RNA, 22 nt, Artificial Sequence
  Guide Sequence
ccgcucucgcgacuccuggcgg

SEQ ID NO: 14666 - RNA, 22 nt, Artificial Sequence
  Guide Sequence
ccggaaaagggguuguuccgcc

SEQ ID NO: 14667 - RNA, 22 nt, Artificial Sequence
  Guide Sequence
ccggacaugcccggucagcgcc

SEQ ID NO: 14668 - RNA, 22 nt, Artificial Sequence
  Guide Sequence
ccggacgccgaagccucagagc

SEQ ID NO: 14669 - RNA, 22 nt, Artificial Sequence
  Guide Sequence
ccggccagggaacagccacuuc

SEQ ID NO: 14670 - RNA, 22 nt, Artificial Sequence
  Guide Sequence
ccggccgugcugaagcaacuuc

SEQ ID NO: 14671 - RNA, 22 nt, Artificial Sequence
  Guide Sequence
ccggucagcgccguccgggaac

SEQ ID NO: 14672 - RNA, 22 nt, Artificial Sequence
  Guide Sequence
ccguccgggaaccgagcguggg

SEQ ID NO: 14673 - RNA, 22 nt, Artificial Sequence
  Guide Sequence
ccgucucccgcucucgcgacuc

SEQ ID NO: 14674 - RNA, 22 nt, Artificial Sequence
  Guide Sequence
ccgugcugaagcaacuuccgcc

SEQ ID NO: 14675 - RNA, 22 nt, Artificial Sequence
  Guide Sequence
ccuagagccgcggccacgugcg

SEQ ID NO: 14676 - RNA, 22 nt, Artificial Sequence
  Guide Sequence
ccuagguucccugucacaguuc

SEQ ID NO: 14677 - RNA, 22 nt, Artificial Sequence
  Guide Sequence
ccucagagcgcgugccugaggg

SEQ ID NO: 14678 - RNA, 22 nt, Artificial Sequence
  Guide Sequence
ccucgcccuuccccuagguucc

SEQ ID NO: 14679 - RNA, 22 nt, Artificial Sequence
  Guide Sequence
ccugagaaggguggggcuuccg

SEQ ID NO: 14680 - RNA, 22 nt, Artificial Sequence
  Guide Sequence
ccuggcggugaaggacggaaga

SEQ ID NO: 14681 - RNA, 22 nt, Artificial Sequence
  Guide Sequence
ccugucacaguuccgcccuuac

SEQ ID NO: 14682 - RNA, 22 nt, Artificial Sequence
  Guide Sequence
ccuuacuacucccacuuccggc

SEQ ID NO: 14683 - RNA, 22 nt, Artificial Sequence
  Guide Sequence
ccuuccccuagguucccuguca

SEQ ID NO: 14684 - RNA, 22 nt, Artificial Sequence
  Guide Sequence
cgaagccucagagcgcgugccu

SEQ ID NO: 14685 - RNA, 22 nt, Artificial Sequence
  Guide Sequence
cgacuccuggcggugaaggacg

SEQ ID NO: 14686 - RNA, 22 nt, Artificial Sequence
  Guide Sequence
cgagcggcaggcccggacaugc

SEQ ID NO: 14687 - RNA, 22 nt, Artificial Sequence
  Guide Sequence
cgccagcuguggcccacccauc

SEQ ID NO: 14688 - RNA, 22 nt, Artificial Sequence
  Guide Sequence
cgccccggccgugcugaagcaa

SEQ ID NO: 14689 - RNA, 22 nt, Artificial Sequence
  Guide Sequence
cgcccugagaaggguggggcuu

SEQ ID NO: 14690 - RNA, 22 nt, Artificial Sequence
  Guide Sequence
cgcccuuacuacucccacuucc

SEQ ID NO: 14691 - RNA, 22 nt, Artificial Sequence
  Guide Sequence
cgcccuuccccuagguucccug

SEQ ID NO: 14692 - RNA, 22 nt, Artificial Sequence
  Guide Sequence
cgccgaagccucagagcgcgug

SEQ ID NO: 14693 - RNA, 22 nt, Artificial Sequence
  Guide Sequence
cgccguccgggaaccgagcgug

SEQ ID NO: 14694 - RNA, 22 nt, Artificial Sequence
  Guide Sequence
cgcgacuccuggcggugaagga

SEQ ID NO: 14695 - RNA, 22 nt, Artificial Sequence
  Guide Sequence
cgcucgccccggccgugcugaa

SEQ ID NO: 14696 - RNA, 22 nt, Artificial Sequence
  Guide Sequence
cgcucucgcgacuccuggcggu

SEQ ID NO: 14697 - RNA, 22 nt, Artificial Sequence
  Guide Sequence
cggaaaagggguuguuccgccg

SEQ ID NO: 14698 - RNA, 22 nt, Artificial Sequence
  Guide Sequence
cggaagaugauagccacauuuc

SEQ ID NO: 14699 - RNA, 22 nt, Artificial Sequence
  Guide Sequence
cggacaugcccggucagcgccg

SEQ ID NO: 14700 - RNA, 22 nt, Artificial Sequence
  Guide Sequence
cggacgccgaagccucagagcg

SEQ ID NO: 14701 - RNA, 22 nt, Artificial Sequence
  Guide Sequence
cggagucccggggcuggggagu

SEQ ID NO: 14702 - RNA, 22 nt, Artificial Sequence
  Guide Sequence
cggccagggaacagccacuucc

SEQ ID NO: 14703 - RNA, 22 nt, Artificial Sequence
  Guide Sequence
cggccgugcugaagcaacuucc

SEQ ID NO: 14704 - RNA, 22 nt, Artificial Sequence
  Guide Sequence
cggucagcgccguccgggaacc

SEQ ID NO: 14705 - RNA, 22 nt, Artificial Sequence
  Guide Sequence
cggugaaggacggaagaugaua

SEQ ID NO: 14706 - RNA, 22 nt, Artificial Sequence
  Guide Sequence
cguccgggaaccgagcgugggc

SEQ ID NO: 14707 - RNA, 22 nt, Artificial Sequence
  Guide Sequence
cgucucccgcucucgcgacucc

SEQ ID NO: 14708 - RNA, 22 nt, Artificial Sequence
  Guide Sequence
cgugcugaagcaacuuccgccc

SEQ ID NO: 14709 - RNA, 22 nt, Artificial Sequence
  Guide Sequence
cuacucccacuuccggccaggg

SEQ ID NO: 14710 - RNA, 22 nt, Artificial Sequence
  Guide Sequence
cuagagccgcggccacgugcga

SEQ ID NO: 14711 - RNA, 22 nt, Artificial Sequence
  Guide Sequence
cuagguucccugucacaguucc

SEQ ID NO: 14712 - RNA, 22 nt, Artificial Sequence
  Guide Sequence
cucagagcgcgugccugagggc

SEQ ID NO: 14713 - RNA, 22 nt, Artificial Sequence
  Guide Sequence
cucccacuuccggccagggaac

SEQ ID NO: 14714 - RNA, 22 nt, Artificial Sequence
  Guide Sequence
cucccgcucucgcgacuccugg

SEQ ID NO: 14715 - RNA, 22 nt, Artificial Sequence
  Guide Sequence
cuccuggcggugaaggacggaa

SEQ ID NO: 14716 - RNA, 22 nt, Artificial Sequence
  Guide Sequence
cucgccccggccgugcugaagc

SEQ ID NO: 14717 - RNA, 22 nt, Artificial Sequence
  Guide Sequence
cucgcccuuccccuagguuccc

SEQ ID NO: 14718 - RNA, 22 nt, Artificial Sequence
  Guide Sequence
cucgcgacuccuggcggugaag

SEQ ID NO: 14719 - RNA, 22 nt, Artificial Sequence
  Guide Sequence
cucucgcgacuccuggcgguga

SEQ ID NO: 14720 - RNA, 22 nt, Artificial Sequence
  Guide Sequence
cugaagcaacuuccgcccugag

SEQ ID NO: 14721 - RNA, 22 nt, Artificial Sequence
  Guide Sequence
cugagaaggguggggcuuccgu

SEQ ID NO: 14722 - RNA, 22 nt, Artificial Sequence
  Guide Sequence
cuggcggugaaggacggaagau

SEQ ID NO: 14723 - RNA, 22 nt, Artificial Sequence
  Guide Sequence
cugucacaguuccgcccuuacu

SEQ ID NO: 14724 - RNA, 22 nt, Artificial Sequence
  Guide Sequence
cuuacuacucccacuuccggcc

SEQ ID NO: 14725 - RNA, 22 nt, Artificial Sequence
  Guide Sequence
cuuccacccggaaaagggguug

SEQ ID NO: 14726 - RNA, 22 nt, Artificial Sequence
  Guide Sequence
cuuccccuagguucccugucac

SEQ ID NO: 14727 - RNA, 22 nt, Artificial Sequence
  Guide Sequence
cuuccgcccugagaaggguggg

SEQ ID NO: 14728 - RNA, 22 nt, Artificial Sequence
  Guide Sequence
cuuccggccagggaacagccac

SEQ ID NO: 14729 - RNA, 22 nt, Artificial Sequence
  Guide Sequence
cuuccgucucccgcucucgcga

SEQ ID NO: 14730 - RNA, 22 nt, Artificial Sequence
  Guide Sequence
cuuccucgcccuuccccuaggu

SEQ ID NO: 14731 - RNA, 22 nt, Artificial Sequence
  Guide Sequence
gaaaagggguuguuccgccgug

SEQ ID NO: 14732 - RNA, 22 nt, Artificial Sequence
  Guide Sequence
gaacagccacuuccacccggaa

SEQ ID NO: 14733 - RNA, 22 nt, Artificial Sequence
  Guide Sequence
gaagaugauagccacauuucuu

SEQ ID NO: 14734 - RNA, 22 nt, Artificial Sequence
  Guide Sequence
gaagcaacuuccgcccugagaa

SEQ ID NO: 14735 - RNA, 22 nt, Artificial Sequence
  Guide Sequence
gaagccucagagcgcgugccug

SEQ ID NO: 14736 - RNA, 22 nt, Artificial Sequence
  Guide Sequence
gaaggacggaagaugauagcca

SEQ ID NO: 14737 - RNA, 22 nt, Artificial Sequence
  Guide Sequence
gaaggguggggcuuccgucucc

SEQ ID NO: 14738 - RNA, 22 nt, Artificial Sequence
  Guide Sequence
gacaugcccggucagcgccguc

SEQ ID NO: 14739 - RNA, 22 nt, Artificial Sequence
  Guide Sequence
gacgccgaagccucagagcgcg

SEQ ID NO: 14740 - RNA, 22 nt, Artificial Sequence
  Guide Sequence
gacggaagaugauagccacauu

SEQ ID NO: 14741 - RNA, 22 nt, Artificial Sequence
  Guide Sequence
gacuccuggcggugaaggacgg

SEQ ID NO: 14742 - RNA, 22 nt, Artificial Sequence
  Guide Sequence
gagaaggguggggcuuccgucu

SEQ ID NO: 14743 - RNA, 22 nt, Artificial Sequence
  Guide Sequence
gagcggcaggcccggacaugcc

SEQ ID NO: 14744 - RNA, 22 nt, Artificial Sequence
  Guide Sequence
gagucccggggcuggggagugg

SEQ ID NO: 14745 - RNA, 22 nt, Artificial Sequence
  Guide Sequence
gauagccacauuucuuccucgc

SEQ ID NO: 14746 - RNA, 22 nt, Artificial Sequence
  Guide Sequence
gaugauagccacauuucuuccu

SEQ ID NO: 14747 - RNA, 22 nt, Artificial Sequence
  Guide Sequence
gcaacuuccgcccugagaaggg

SEQ ID NO: 14748 - RNA, 22 nt, Artificial Sequence
  Guide Sequence
gcaggcccggacaugcccgguc

SEQ ID NO: 14749 - RNA, 22 nt, Artificial Sequence
  Guide Sequence
gcagggccggacgccgaagccu

SEQ ID NO: 14750 - RNA, 22 nt, Artificial Sequence
  Guide Sequence
gccacauuucuuccucgcccuu

SEQ ID NO: 14751 - RNA, 22 nt, Artificial Sequence
  Guide Sequence
gccacuuccacccggaaaaggg

SEQ ID NO: 14752 - RNA, 22 nt, Artificial Sequence
  Guide Sequence
gccagcuguggcccacccaucc

SEQ ID NO: 14753 - RNA, 22 nt, Artificial Sequence
  Guide Sequence
gccagggaacagccacuuccac

SEQ ID NO: 14754 - RNA, 22 nt, Artificial Sequence
  Guide Sequence
gccccggccgugcugaagcaac

SEQ ID NO: 14755 - RNA, 22 nt, Artificial Sequence
  Guide Sequence
gcccggacaugcccggucagcg

SEQ ID NO: 14756 - RNA, 22 nt, Artificial Sequence
  Guide Sequence
gcccugagaaggguggggcuuc

SEQ ID NO: 14757 - RNA, 22 nt, Artificial Sequence
  Guide Sequence
gcccuuacuacucccacuuccg

SEQ ID NO: 14758 - RNA, 22 nt, Artificial Sequence
  Guide Sequence
gcccuuccccuagguucccugu

SEQ ID NO: 14759 - RNA, 22 nt, Artificial Sequence
  Guide Sequence
gccgaagccucagagcgcgugc

SEQ ID NO: 14760 - RNA, 22 nt, Artificial Sequence
  Guide Sequence
gccggacgccgaagccucagag

SEQ ID NO: 14761 - RNA, 22 nt, Artificial Sequence
  Guide Sequence
gccguccgggaaccgagcgugg

SEQ ID NO: 14762 - RNA, 22 nt, Artificial Sequence
  Guide Sequence
gccgugcugaagcaacuuccgc

SEQ ID NO: 14763 - RNA, 22 nt, Artificial Sequence
  Guide Sequence
gccucagagcgcgugccugagg

SEQ ID NO: 14764 - RNA, 22 nt, Artificial Sequence
  Guide Sequence
gcgacuccuggcggugaaggac

SEQ ID NO: 14765 - RNA, 22 nt, Artificial Sequence
  Guide Sequence
gcgagcggcaggcccggacaug

SEQ ID NO: 14766 - RNA, 22 nt, Artificial Sequence
  Guide Sequence
gcgccagcuguggcccacccau

SEQ ID NO: 14767 - RNA, 22 nt, Artificial Sequence
  Guide Sequence
gcgccguccgggaaccgagcgu

SEQ ID NO: 14768 - RNA, 22 nt, Artificial Sequence
  Guide Sequence
gcggugaaggacggaagaugau

SEQ ID NO: 14769 - RNA, 22 nt, Artificial Sequence
  Guide Sequence
gcucgccccggccgugcugaag

SEQ ID NO: 14770 - RNA, 22 nt, Artificial Sequence
  Guide Sequence
gcucucgcgacuccuggcggug

SEQ ID NO: 14771 - RNA, 22 nt, Artificial Sequence
  Guide Sequence
gcugaagcaacuuccgcccuga

SEQ ID NO: 14772 - RNA, 22 nt, Artificial Sequence
  Guide Sequence
gcuuccgucucccgcucucgcg

SEQ ID NO: 14773 - RNA, 22 nt, Artificial Sequence
  Guide Sequence
ggaaaagggguuguuccgccgu

SEQ ID NO: 14774 - RNA, 22 nt, Artificial Sequence
  Guide Sequence
ggaacagccacuuccacccgga

SEQ ID NO: 14775 - RNA, 22 nt, Artificial Sequence
  Guide Sequence
ggaagaugauagccacauuucu

SEQ ID NO: 14776 - RNA, 22 nt, Artificial Sequence
  Guide Sequence
ggacaugcccggucagcgccgu

SEQ ID NO: 14777 - RNA, 22 nt, Artificial Sequence
  Guide Sequence
ggacgccgaagccucagagcgc

SEQ ID NO: 14778 - RNA, 22 nt, Artificial Sequence
  Guide Sequence
ggacggaagaugauagccacau

SEQ ID NO: 14779 - RNA, 22 nt, Artificial Sequence
  Guide Sequence
ggagucccggggcuggggagug

SEQ ID NO: 14780 - RNA, 22 nt, Artificial Sequence
  Guide Sequence
ggcaggcccggacaugcccggu

SEQ ID NO: 14781 - RNA, 22 nt, Artificial Sequence
  Guide Sequence
ggccagggaacagccacuucca

SEQ ID NO: 14782 - RNA, 22 nt, Artificial Sequence
  Guide Sequence
ggcccggacaugcccggucagc

SEQ ID NO: 14783 - RNA, 22 nt, Artificial Sequence
  Guide Sequence
ggccggacgccgaagccucaga

SEQ ID NO: 14784 - RNA, 22 nt, Artificial Sequence
  Guide Sequence
ggccgugcugaagcaacuuccg

SEQ ID NO: 14785 - RNA, 22 nt, Artificial Sequence
  Guide Sequence
ggcgccagcuguggcccaccca

SEQ ID NO: 14786 - RNA, 22 nt, Artificial Sequence
  Guide Sequence
ggcggugaaggacggaagauga

SEQ ID NO: 14787 - RNA, 22 nt, Artificial Sequence
  Guide Sequence
ggcuuccgucucccgcucucgc

SEQ ID NO: 14788 - RNA, 22 nt, Artificial Sequence
  Guide Sequence
gggaacagccacuuccacccgg

SEQ ID NO: 14789 - RNA, 22 nt, Artificial Sequence
  Guide Sequence
gggccggacgccgaagccucag

SEQ ID NO: 14790 - RNA, 22 nt, Artificial Sequence
  Guide Sequence
gggcuuccgucucccgcucucg

SEQ ID NO: 14791 - RNA, 22 nt, Artificial Sequence
  Guide Sequence
ggggcuuccgucucccgcucuc

SEQ ID NO: 14792 - RNA, 22 nt, Artificial Sequence
  Guide Sequence
gggguuguuccgccguggggcg

SEQ ID NO: 14793 - RNA, 22 nt, Artificial Sequence
  Guide Sequence
gggugcguggggcguccggagu

SEQ ID NO: 14794 - RNA, 22 nt, Artificial Sequence
  Guide Sequence
ggguggggcuuccgucucccgc

SEQ ID NO: 14795 - RNA, 22 nt, Artificial Sequence
  Guide Sequence
ggguuguuccgccguggggcgc

SEQ ID NO: 14796 - RNA, 22 nt, Artificial Sequence
  Guide Sequence
gguaagcgggggcuccgagcug

SEQ ID NO: 14797 - RNA, 22 nt, Artificial Sequence
  Guide Sequence
ggucagcgccguccgggaaccg

SEQ ID NO: 14798 - RNA, 22 nt, Artificial Sequence
  Guide Sequence
ggugaaggacggaagaugauag

SEQ ID NO: 14799 - RNA, 22 nt, Artificial Sequence
  Guide Sequence
ggugcguggggcguccggaguc

SEQ ID NO: 14800 - RNA, 22 nt, Artificial Sequence
  Guide Sequence
gguggggcuuccgucucccgcu

SEQ ID NO: 14801 - RNA, 22 nt, Artificial Sequence
  Guide Sequence
gguucccugucacaguuccgcc

SEQ ID NO: 14802 - RNA, 22 nt, Artificial Sequence
  Guide Sequence
gguuguuccgccguggggcgcc

SEQ ID NO: 14803 - RNA, 22 nt, Artificial Sequence
  Guide Sequence
guaagcgggggcuccgagcugg

SEQ ID NO: 14804 - RNA, 22 nt, Artificial Sequence
  Guide Sequence
gucacaguuccgcccuuacuac

SEQ ID NO: 14805 - RNA, 22 nt, Artificial Sequence
  Guide Sequence
gucagcgccguccgggaaccga

SEQ ID NO: 14806 - RNA, 22 nt, Artificial Sequence
  Guide Sequence
guccgggaaccgagcgugggcc

SEQ ID NO: 14807 - RNA, 22 nt, Artificial Sequence
  Guide Sequence
gucucccgcucucgcgacuccu

SEQ ID NO: 14808 - RNA, 22 nt, Artificial Sequence
  Guide Sequence
gugaaggacggaagaugauagc

SEQ ID NO: 14809 - RNA, 22 nt, Artificial Sequence
  Guide Sequence
gugcgagcggcaggcccggaca

SEQ ID NO: 14810 - RNA, 22 nt, Artificial Sequence
  Guide Sequence
gugcguggggcguccggagucc

SEQ ID NO: 14811 - RNA, 22 nt, Artificial Sequence
  Guide Sequence
gugcugaagcaacuuccgcccu

SEQ ID NO: 14812 - RNA, 22 nt, Artificial Sequence
  Guide Sequence
guggggcgccagcuguggccca

SEQ ID NO: 14813 - RNA, 22 nt, Artificial Sequence
  Guide Sequence
guggggcuuccgucucccgcuc

SEQ ID NO: 14814 - RNA, 22 nt, Artificial Sequence
  Guide Sequence
guucccugucacaguuccgccc

SEQ ID NO: 14815 - RNA, 22 nt, Artificial Sequence
  Guide Sequence
guuccgcccuuacuacucccac

SEQ ID NO: 14816 - RNA, 22 nt, Artificial Sequence
  Guide Sequence
guuccgccguggggcgccagcu

SEQ ID NO: 14817 - RNA, 22 nt, Artificial Sequence
  Guide Sequence
guuguuccgccguggggcgcca

SEQ ID NO: 14818 - RNA, 22 nt, Artificial Sequence
  Guide Sequence
uaagcgggggcuccgagcugga

SEQ ID NO: 14819 - RNA, 22 nt, Artificial Sequence
  Guide Sequence
uacuacucccacuuccggccag

SEQ ID NO: 14820 - RNA, 22 nt, Artificial Sequence
  Guide Sequence
uacucccacuuccggccaggga

SEQ ID NO: 14821 - RNA, 22 nt, Artificial Sequence
  Guide Sequence
uagagccgcggccacgugcgag

SEQ ID NO: 14822 - RNA, 22 nt, Artificial Sequence
  Guide Sequence
uagccacauuucuuccucgccc

SEQ ID NO: 14823 - RNA, 22 nt, Artificial Sequence
  Guide Sequence
uagguucccugucacaguuccg

SEQ ID NO: 14824 - RNA, 22 nt, Artificial Sequence
  Guide Sequence
ucacaguuccgcccuuacuacu

SEQ ID NO: 14825 - RNA, 22 nt, Artificial Sequence
  Guide Sequence
ucagagcgcgugccugagggcc

SEQ ID NO: 14826 - RNA, 22 nt, Artificial Sequence
  Guide Sequence
ucagcgccguccgggaaccgag

SEQ ID NO: 14827 - RNA, 22 nt, Artificial Sequence
  Guide Sequence
uccacccggaaaagggguuguu

SEQ ID NO: 14828 - RNA, 22 nt, Artificial Sequence
  Guide Sequence
ucccacuuccggccagggaaca

SEQ ID NO: 14829 - RNA, 22 nt, Artificial Sequence
  Guide Sequence
uccccuagguucccugucacag

SEQ ID NO: 14830 - RNA, 22 nt, Artificial Sequence
  Guide Sequence
ucccgcucucgcgacuccuggc

SEQ ID NO: 14831 - RNA, 22 nt, Artificial Sequence
  Guide Sequence
ucccugucacaguuccgcccuu

SEQ ID NO: 14832 - RNA, 22 nt, Artificial Sequence
  Guide Sequence
uccgcccugagaaggguggggc

SEQ ID NO: 14833 - RNA, 22 nt, Artificial Sequence
  Guide Sequence
uccgcccuuacuacucccacuu

SEQ ID NO: 14834 - RNA, 22 nt, Artificial Sequence
  Guide Sequence
uccgccguggggcgccagcugu

SEQ ID NO: 14835 - RNA, 22 nt, Artificial Sequence
  Guide Sequence
uccggagucccggggcugggga

SEQ ID NO: 14836 - RNA, 22 nt, Artificial Sequence
  Guide Sequence
uccggccagggaacagccacuu

SEQ ID NO: 14837 - RNA, 22 nt, Artificial Sequence
  Guide Sequence
uccgggaaccgagcgugggccc

SEQ ID NO: 14838 - RNA, 22 nt, Artificial Sequence
  Guide Sequence
uccgucucccgcucucgcgacu

SEQ ID NO: 14839 - RNA, 22 nt, Artificial Sequence
  Guide Sequence
uccucgcccuuccccuagguuc

SEQ ID NO: 14840 - RNA, 22 nt, Artificial Sequence
  Guide Sequence
uccuggcggugaaggacggaag

SEQ ID NO: 14841 - RNA, 22 nt, Artificial Sequence
  Guide Sequence
ucgccccggccgugcugaagca

SEQ ID NO: 14842 - RNA, 22 nt, Artificial Sequence
  Guide Sequence
ucgcccuuccccuagguucccu

SEQ ID NO: 14843 - RNA, 22 nt, Artificial Sequence
  Guide Sequence
ucgcgacuccuggcggugaagg

SEQ ID NO: 14844 - RNA, 22 nt, Artificial Sequence
  Guide Sequence
ucgcucgccccggccgugcuga

SEQ ID NO: 14845 - RNA, 22 nt, Artificial Sequence
  Guide Sequence
ucucccgcucucgcgacuccug

SEQ ID NO: 14846 - RNA, 22 nt, Artificial Sequence
  Guide Sequence
ucucgcgacuccuggcggugaa

SEQ ID NO: 14847 - RNA, 22 nt, Artificial Sequence
  Guide Sequence
ucuuccucgcccuuccccuagg

SEQ ID NO: 14848 - RNA, 22 nt, Artificial Sequence
  Guide Sequence
ugaagcaacuuccgcccugaga

SEQ ID NO: 14849 - RNA, 22 nt, Artificial Sequence
  Guide Sequence
ugaaggacggaagaugauagcc

SEQ ID NO: 14850 - RNA, 22 nt, Artificial Sequence
  Guide Sequence
ugagaaggguggggcuuccguc

SEQ ID NO: 14851 - RNA, 22 nt, Artificial Sequence
  Guide Sequence
ugauagccacauuucuuccucg

SEQ ID NO: 14852 - RNA, 22 nt, Artificial Sequence
  Guide Sequence
ugcgagcggcaggcccggacau

SEQ ID NO: 14853 - RNA, 22 nt, Artificial Sequence
  Guide Sequence
ugcguggggcguccggaguccc

SEQ ID NO: 14854 - RNA, 22 nt, Artificial Sequence
  Guide Sequence
ugcugaagcaacuuccgcccug

SEQ ID NO: 14855 - RNA, 22 nt, Artificial Sequence
  Guide Sequence
uggcggugaaggacggaagaug

SEQ ID NO: 14856 - RNA, 22 nt, Artificial Sequence
  Guide Sequence
uggggcgccagcuguggcccac

SEQ ID NO: 14857 - RNA, 22 nt, Artificial Sequence
  Guide Sequence
uggggcuuccgucucccgcucu

SEQ ID NO: 14858 - RNA, 22 nt, Artificial Sequence
  Guide Sequence
ugucacaguuccgcccuuacua

SEQ ID NO: 14859 - RNA, 22 nt, Artificial Sequence
  Guide Sequence
uguuccgccguggggcgccagc

SEQ ID NO: 14860 - RNA, 22 nt, Artificial Sequence
  Guide Sequence
uuacuacucccacuuccggcca

SEQ ID NO: 14861 - RNA, 22 nt, Artificial Sequence
  Guide Sequence
uuccacccggaaaagggguugu

SEQ ID NO: 14862 - RNA, 22 nt, Artificial Sequence
  Guide Sequence
uuccccuagguucccugucaca

SEQ ID NO: 14863 - RNA, 22 nt, Artificial Sequence
  Guide Sequence
uucccugucacaguuccgcccu

SEQ ID NO: 14864 - RNA, 22 nt, Artificial Sequence
  Guide Sequence
uuccgcccugagaagggugggg

SEQ ID NO: 14865 - RNA, 22 nt, Artificial Sequence
  Guide Sequence
uuccgcccuuacuacucccacu

SEQ ID NO: 14866 - RNA, 22 nt, Artificial Sequence
  Guide Sequence
uuccgccguggggcgccagcug

SEQ ID NO: 14867 - RNA, 22 nt, Artificial Sequence
  Guide Sequence
uuccggccagggaacagccacu

SEQ ID NO: 14868 - RNA, 22 nt, Artificial Sequence
  Guide Sequence
uuccgucucccgcucucgcgac

SEQ ID NO: 14869 - RNA, 22 nt, Artificial Sequence
  Guide Sequence
uuccucgcccuuccccuagguu

SEQ ID NO: 14870 - RNA, 22 nt, Artificial Sequence
  Guide Sequence
uucgcucgccccggccgugcug

SEQ ID NO: 14871 - RNA, 22 nt, Artificial Sequence
  Guide Sequence
uucuuccucgcccuuccccuag

SEQ ID NO: 14872 - RNA, 22 nt, Artificial Sequence
  Guide Sequence
uuguuccgccguggggcgccag

SEQ ID NO: 14873 - RNA, 22 nt, Artificial Sequence
  Guide Sequence
uuucgcucgccccggccgugcu

SEQ ID NO: 14874 - RNA, 22 nt, Artificial Sequence
  Guide Sequence
uuucuuccucgcccuuccccua

SEQ ID NO: 14875 - RNA, 20 nt, Artificial Sequence
  Guide Sequence
aaaacggguggaggcugucg

SEQ ID NO: 14876 - RNA, 20 nt, Artificial Sequence
  Guide Sequence
aaacggguggaggcugucgc

SEQ ID NO: 14877 - RNA, 20 nt, Artificial Sequence
  Guide Sequence
aaaggauugggguggggucc

SEQ ID NO: 14878 - RNA, 20 nt, Artificial Sequence
  Guide Sequence
aacgggggguaccacgguuu

SEQ ID NO: 14879 - RNA, 20 nt, Artificial Sequence
  Guide Sequence
aacggguggaggcugucgcc

SEQ ID NO: 14880 - RNA, 20 nt, Artificial Sequence
  Guide Sequence
aaggauuggggugggguccg

SEQ ID NO: 14881 - RNA, 20 nt, Artificial Sequence
  Guide Sequence
aaggggccgugggaaguaac

SEQ ID NO: 14882 - RNA, 20 nt, Artificial Sequence
  Guide Sequence
aaguaacgggggguaccacg

SEQ ID NO: 14883 - RNA, 20 nt, Artificial Sequence
  Guide Sequence
acacgcaggggccgggcucu

SEQ ID NO: 14884 - RNA, 20 nt, Artificial Sequence
  Guide Sequence
acagcauaguuguguugagg

SEQ ID NO: 14885 - RNA, 20 nt, Artificial Sequence
  Guide Sequence
accacgguuuaggaugcgcu

SEQ ID NO: 14886 - RNA, 20 nt, Artificial Sequence
  Guide Sequence
acccgcaggagccggagccc

SEQ ID NO: 14887 - RNA, 20 nt, Artificial Sequence
  Guide Sequence
acgcaggggccgggcucugu

SEQ ID NO: 14888 - RNA, 20 nt, Artificial Sequence
  Guide Sequence
acgggggguaccacgguuua

SEQ ID NO: 14889 - RNA, 20 nt, Artificial Sequence
  Guide Sequence
acggguggaggcugucgccu

SEQ ID NO: 14890 - RNA, 20 nt, Artificial Sequence
  Guide Sequence
acgguuuaggaugcgcugga

SEQ ID NO: 14891 - RNA, 20 nt, Artificial Sequence
  Guide Sequence
acucugggcacagcauaguu

SEQ ID NO: 14892 - RNA, 20 nt, Artificial Sequence
  Guide Sequence
acugagguucaaaacgggug

SEQ ID NO: 14893 - RNA, 20 nt, Artificial Sequence
  Guide Sequence
agacccgcaggagccggagc

SEQ ID NO: 14894 - RNA, 20 nt, Artificial Sequence
  Guide Sequence
agagaggccgugggcgucgg

SEQ ID NO: 14895 - RNA, 20 nt, Artificial Sequence
  Guide Sequence
agaggccgugggcgucggug

SEQ ID NO: 14896 - RNA, 20 nt, Artificial Sequence
  Guide Sequence
agcauaguuguguugagggg

SEQ ID NO: 14897 - RNA, 20 nt, Artificial Sequence
  Guide Sequence
agcccggcguugaaggggcc

SEQ ID NO: 14898 - RNA, 20 nt, Artificial Sequence
  Guide Sequence
agccggagcccggcguugaa

SEQ ID NO: 14899 - RNA, 20 nt, Artificial Sequence
  Guide Sequence
agccucucuuuguacucugg

SEQ ID NO: 14900 - RNA, 20 nt, Artificial Sequence
  Guide Sequence
agcgaaaggauugggguggg

SEQ ID NO: 14901 - RNA, 20 nt, Artificial Sequence
  Guide Sequence
agcgugaggccuggcuugug

SEQ ID NO: 14902 - RNA, 20 nt, Artificial Sequence
  Guide Sequence
agcuccuucagacccgcagg

SEQ ID NO: 14903 - RNA, 20 nt, Artificial Sequence
  Guide Sequence
aggagccggagcccggcguu

SEQ ID NO: 14904 - RNA, 20 nt, Artificial Sequence
  Guide Sequence
aggauccucacacgcagggg

SEQ ID NO: 14905 - RNA, 20 nt, Artificial Sequence
  Guide Sequence
aggaugcgcuggagcgaaag

SEQ ID NO: 14906 - RNA, 20 nt, Artificial Sequence
  Guide Sequence
aggauuggggugggguccgu

SEQ ID NO: 14907 - RNA, 20 nt, Artificial Sequence
  Guide Sequence
aggccgugggcgucggugag

SEQ ID NO: 14908 - RNA, 20 nt, Artificial Sequence
  Guide Sequence
aggccuggcuuguguuccgg

SEQ ID NO: 14909 - RNA, 20 nt, Artificial Sequence
  Guide Sequence
aggccuguguucacaugcuu

SEQ ID NO: 14910 - RNA, 20 nt, Artificial Sequence
  Guide Sequence
aggcugucgccuuggccugc

SEQ ID NO: 14911 - RNA, 20 nt, Artificial Sequence
  Guide Sequence
aggcuuguuuggggccuccg

SEQ ID NO: 14912 - RNA, 20 nt, Artificial Sequence
  Guide Sequence
agggcauuugggauaugggg

SEQ ID NO: 14913 - RNA, 20 nt, Artificial Sequence
  Guide Sequence
aggggagggcauuugggaua

SEQ ID NO: 14914 - RNA, 20 nt, Artificial Sequence
  Guide Sequence
aggggccgggcucuguuagu

SEQ ID NO: 14915 - RNA, 20 nt, Artificial Sequence
  Guide Sequence
aggggccgugggaaguaacg

SEQ ID NO: 14916 - RNA, 20 nt, Artificial Sequence
  Guide Sequence
agguucaaaacggguggagg

SEQ ID NO: 14917 - RNA, 20 nt, Artificial Sequence
  Guide Sequence
aguaacgggggguaccacgg

SEQ ID NO: 14918 - RNA, 20 nt, Artificial Sequence
  Guide Sequence
agucgucucugccaggccug

SEQ ID NO: 14919 - RNA, 20 nt, Artificial Sequence
  Guide Sequence
agugaguuuggggacugagg

SEQ ID NO: 14920 - RNA, 20 nt, Artificial Sequence
  Guide Sequence
agugcgauccagagaggccg

SEQ ID NO: 14921 - RNA, 20 nt, Artificial Sequence
  Guide Sequence
aguggggucgcgcaggaucc

SEQ ID NO: 14922 - RNA, 20 nt, Artificial Sequence
  Guide Sequence
aguuguguugaggggagggc

SEQ ID NO: 14923 - RNA, 20 nt, Artificial Sequence
  Guide Sequence
aguuuggggacugagguuca

SEQ ID NO: 14924 - RNA, 20 nt, Artificial Sequence
  Guide Sequence
aguuuguggagaugacugaa

SEQ ID NO: 14925 - RNA, 20 nt, Artificial Sequence
  Guide Sequence
auaguuguguugaggggagg

SEQ ID NO: 14926 - RNA, 20 nt, Artificial Sequence
  Guide Sequence
auaugggguaguuuguggag

SEQ ID NO: 14927 - RNA, 20 nt, Artificial Sequence
  Guide Sequence
auccagagaggccgugggcg

SEQ ID NO: 14928 - RNA, 20 nt, Artificial Sequence
  Guide Sequence
auccucacacgcaggggccg

SEQ ID NO: 14929 - RNA, 20 nt, Artificial Sequence
  Guide Sequence
augcgcuggagcgaaaggau

SEQ ID NO: 14930 - RNA, 20 nt, Artificial Sequence
  Guide Sequence
augggguaguuuguggagau

SEQ ID NO: 14931 - RNA, 20 nt, Artificial Sequence
  Guide Sequence
auuggggugggguccgugcu

SEQ ID NO: 14932 - RNA, 20 nt, Artificial Sequence
  Guide Sequence
auuugggauaugggguaguu

SEQ ID NO: 14933 - RNA, 20 nt, Artificial Sequence
  Guide Sequence
caaaacggguggaggcuguc

SEQ ID NO: 14934 - RNA, 20 nt, Artificial Sequence
  Guide Sequence
cacacgcaggggccgggcuc

SEQ ID NO: 14935 - RNA, 20 nt, Artificial Sequence
  Guide Sequence
cacagcauaguuguguugag

SEQ ID NO: 14936 - RNA, 20 nt, Artificial Sequence
  Guide Sequence
cacgcaggggccgggcucug

SEQ ID NO: 14937 - RNA, 20 nt, Artificial Sequence
  Guide Sequence
cacgguuuaggaugcgcugg

SEQ ID NO: 14938 - RNA, 20 nt, Artificial Sequence
  Guide Sequence
cagacccgcaggagccggag

SEQ ID NO: 14939 - RNA, 20 nt, Artificial Sequence
  Guide Sequence
cagagaggccgugggcgucg

SEQ ID NO: 14940 - RNA, 20 nt, Artificial Sequence
  Guide Sequence
cagcauaguuguguugaggg

SEQ ID NO: 14941 - RNA, 20 nt, Artificial Sequence
  Guide Sequence
cagccucucuuuguacucug

SEQ ID NO: 14942 - RNA, 20 nt, Artificial Sequence
  Guide Sequence
cagcgugaggccuggcuugu

SEQ ID NO: 14943 - RNA, 20 nt, Artificial Sequence
  Guide Sequence
caggagccggagcccggcgu

SEQ ID NO: 14944 - RNA, 20 nt, Artificial Sequence
  Guide Sequence
caggauccucacacgcaggg

SEQ ID NO: 14945 - RNA, 20 nt, Artificial Sequence
  Guide Sequence
caggccuguguucacaugcu

SEQ ID NO: 14946 - RNA, 20 nt, Artificial Sequence
  Guide Sequence
caggggccgggcucuguuag

SEQ ID NO: 14947 - RNA, 20 nt, Artificial Sequence
  Guide Sequence
cagucgucucugccaggccu

SEQ ID NO: 14948 - RNA, 20 nt, Artificial Sequence
  Guide Sequence
cauaguuguguugaggggag

SEQ ID NO: 14949 - RNA, 20 nt, Artificial Sequence
  Guide Sequence
caucugagccccaguguuug

SEQ ID NO: 14950 - RNA, 20 nt, Artificial Sequence
  Guide Sequence
cauuugggauaugggguagu

SEQ ID NO: 14951 - RNA, 20 nt, Artificial Sequence
  Guide Sequence
ccacgguuuaggaugcgcug

SEQ ID NO: 14952 - RNA, 20 nt, Artificial Sequence
  Guide Sequence
ccagagaggccgugggcguc

SEQ ID NO: 14953 - RNA, 20 nt, Artificial Sequence
  Guide Sequence
ccagccucucuuuguacucu

SEQ ID NO: 14954 - RNA, 20 nt, Artificial Sequence
  Guide Sequence
ccaggccuguguucacaugc

SEQ ID NO: 14955 - RNA, 20 nt, Artificial Sequence
  Guide Sequence
ccaucugagccccaguguuu

SEQ ID NO: 14956 - RNA, 20 nt, Artificial Sequence
  Guide Sequence
cccaucugagccccaguguu

SEQ ID NO: 14957 - RNA, 20 nt, Artificial Sequence
  Guide Sequence
cccggcguugaaggggccgu

SEQ ID NO: 14958 - RNA, 20 nt, Artificial Sequence
  Guide Sequence
ccggagcccggcguugaagg

SEQ ID NO: 14959 - RNA, 20 nt, Artificial Sequence
  Guide Sequence
ccggcguugaaggggccgug

SEQ ID NO: 14960 - RNA, 20 nt, Artificial Sequence
  Guide Sequence
ccgggcucuguuagugcgau

SEQ ID NO: 14961 - RNA, 20 nt, Artificial Sequence
  Guide Sequence
ccgguuccagccucucuuug

SEQ ID NO: 14962 - RNA, 20 nt, Artificial Sequence
  Guide Sequence
ccgugcucuuggcagucguc

SEQ ID NO: 14963 - RNA, 20 nt, Artificial Sequence
  Guide Sequence
ccguggcuccuuucagcgug

SEQ ID NO: 14964 - RNA, 20 nt, Artificial Sequence
  Guide Sequence
ccgugggaaguaacgggggg

SEQ ID NO: 14965 - RNA, 20 nt, Artificial Sequence
  Guide Sequence
ccgugggcgucggugagcuc

SEQ ID NO: 14966 - RNA, 20 nt, Artificial Sequence
  Guide Sequence
ccucacacgcaggggccggg

SEQ ID NO: 14967 - RNA, 20 nt, Artificial Sequence
  Guide Sequence
ccuccguggcuccuuucagc

SEQ ID NO: 14968 - RNA, 20 nt, Artificial Sequence
  Guide Sequence
ccucucuuuguacucugggc

SEQ ID NO: 14969 - RNA, 20 nt, Artificial Sequence
  Guide Sequence
ccugcccaucugagccccag

SEQ ID NO: 14970 - RNA, 20 nt, Artificial Sequence
  Guide Sequence
ccuggcuuguguuccgguuc

SEQ ID NO: 14971 - RNA, 20 nt, Artificial Sequence
  Guide Sequence
ccuucagacccgcaggagcc

SEQ ID NO: 14972 - RNA, 20 nt, Artificial Sequence
  Guide Sequence
ccuuggccugcccaucugag

SEQ ID NO: 14973 - RNA, 20 nt, Artificial Sequence
  Guide Sequence
ccuuucagcgugaggccugg

SEQ ID NO: 14974 - RNA, 20 nt, Artificial Sequence
  Guide Sequence
cgaaaggauugggguggggu

SEQ ID NO: 14975 - RNA, 20 nt, Artificial Sequence
  Guide Sequence
cgaggcuuguuuggggccuc

SEQ ID NO: 14976 - RNA, 20 nt, Artificial Sequence
  Guide Sequence
cgauccagagaggccguggg

SEQ ID NO: 14977 - RNA, 20 nt, Artificial Sequence
  Guide Sequence
cgcaggauccucacacgcag

SEQ ID NO: 14978 - RNA, 20 nt, Artificial Sequence
  Guide Sequence
cgcaggggccgggcucuguu

SEQ ID NO: 14979 - RNA, 20 nt, Artificial Sequence
  Guide Sequence
cgccuuggccugcccaucug

SEQ ID NO: 14980 - RNA, 20 nt, Artificial Sequence
  Guide Sequence
cgcgcaggauccucacacgc

SEQ ID NO: 14981 - RNA, 20 nt, Artificial Sequence
  Guide Sequence
cgcuggagcgaaaggauugg

SEQ ID NO: 14982 - RNA, 20 nt, Artificial Sequence
  Guide Sequence
cggagcccggcguugaaggg

SEQ ID NO: 14983 - RNA, 20 nt, Artificial Sequence
  Guide Sequence
cggcguugaaggggccgugg

SEQ ID NO: 14984 - RNA, 20 nt, Artificial Sequence
  Guide Sequence
cgggcucuguuagugcgauc

SEQ ID NO: 14985 - RNA, 20 nt, Artificial Sequence
  Guide Sequence
cgggggguaccacgguuuag

SEQ ID NO: 14986 - RNA, 20 nt, Artificial Sequence
  Guide Sequence
cggguggaggcugucgccuu

SEQ ID NO: 14987 - RNA, 20 nt, Artificial Sequence
  Guide Sequence
cggugagcuccuucagaccc

SEQ ID NO: 14988 - RNA, 20 nt, Artificial Sequence
  Guide Sequence
cgguuccagccucucuuugu

SEQ ID NO: 14989 - RNA, 20 nt, Artificial Sequence
  Guide Sequence
cgguuuaggaugcgcuggag

SEQ ID NO: 14990 - RNA, 20 nt, Artificial Sequence
  Guide Sequence
cgucggugagcuccuucaga

SEQ ID NO: 14991 - RNA, 20 nt, Artificial Sequence
  Guide Sequence
cgucucugccaggccugugu

SEQ ID NO: 14992 - RNA, 20 nt, Artificial Sequence
  Guide Sequence
cgugaggccuggcuuguguu

SEQ ID NO: 14993 - RNA, 20 nt, Artificial Sequence
  Guide Sequence
cgugcucuuggcagucgucu

SEQ ID NO: 14994 - RNA, 20 nt, Artificial Sequence
  Guide Sequence
cguggcuccuuucagcguga

SEQ ID NO: 14995 - RNA, 20 nt, Artificial Sequence
  Guide Sequence
cgugggaaguaacggggggu

SEQ ID NO: 14996 - RNA, 20 nt, Artificial Sequence
  Guide Sequence
cgugggcgucggugagcucc

SEQ ID NO: 14997 - RNA, 20 nt, Artificial Sequence
  Guide Sequence
cguugaaggggccgugggaa

SEQ ID NO: 14998 - RNA, 20 nt, Artificial Sequence
  Guide Sequence
cucacacgcaggggccgggc

SEQ ID NO: 14999 - RNA, 20 nt, Artificial Sequence
  Guide Sequence
cuccguggcuccuuucagcg

SEQ ID NO: 15000 - RNA, 20 nt, Artificial Sequence
  Guide Sequence
cuccuucagacccgcaggag

SEQ ID NO: 15001 - RNA, 20 nt, Artificial Sequence
  Guide Sequence
cuccuuucagcgugaggccu

SEQ ID NO: 15002 - RNA, 20 nt, Artificial Sequence
  Guide Sequence
cucucuuuguacucugggca

SEQ ID NO: 15003 - RNA, 20 nt, Artificial Sequence
  Guide Sequence
cucugccaggccuguguuca

SEQ ID NO: 15004 - RNA, 20 nt, Artificial Sequence
  Guide Sequence
cucugggcacagcauaguug

SEQ ID NO: 15005 - RNA, 20 nt, Artificial Sequence
  Guide Sequence
cucuguuagugcgauccaga

SEQ ID NO: 15006 - RNA, 20 nt, Artificial Sequence
  Guide Sequence
cucuuggcagucgucucugc

SEQ ID NO: 15007 - RNA, 20 nt, Artificial Sequence
  Guide Sequence
cucuuuguacucugggcaca

SEQ ID NO: 15008 - RNA, 20 nt, Artificial Sequence
  Guide Sequence
cugagguucaaaacgggugg

SEQ ID NO: 15009 - RNA, 20 nt, Artificial Sequence
  Guide Sequence
cugccaggccuguguucaca

SEQ ID NO: 15010 - RNA, 20 nt, Artificial Sequence
  Guide Sequence
cugcccaucugagccccagu

SEQ ID NO: 15011 - RNA, 20 nt, Artificial Sequence
  Guide Sequence
cuggagcgaaaggauugggg

SEQ ID NO: 15012 - RNA, 20 nt, Artificial Sequence
  Guide Sequence
cuggcuuguguuccgguucc

SEQ ID NO: 15013 - RNA, 20 nt, Artificial Sequence
  Guide Sequence
cugggcacagcauaguugug

SEQ ID NO: 15014 - RNA, 20 nt, Artificial Sequence
  Guide Sequence
cugucgccuuggccugccca

SEQ ID NO: 15015 - RNA, 20 nt, Artificial Sequence
  Guide Sequence
cuguuagugcgauccagaga

SEQ ID NO: 15016 - RNA, 20 nt, Artificial Sequence
  Guide Sequence
cuucagacccgcaggagccg

SEQ ID NO: 15017 - RNA, 20 nt, Artificial Sequence
  Guide Sequence
cuuggcagucgucucugcca

SEQ ID NO: 15018 - RNA, 20 nt, Artificial Sequence
  Guide Sequence
cuuggccugcccaucugagc

SEQ ID NO: 15019 - RNA, 20 nt, Artificial Sequence
  Guide Sequence
cuuguguuccgguuccagcc

SEQ ID NO: 15020 - RNA, 20 nt, Artificial Sequence
  Guide Sequence
cuuguuuggggccuccgugg

SEQ ID NO: 15021 - RNA, 20 nt, Artificial Sequence
  Guide Sequence
cuuucagcgugaggccuggc

SEQ ID NO: 15022 - RNA, 20 nt, Artificial Sequence
  Guide Sequence
cuuuguacucugggcacagc

SEQ ID NO: 15023 - RNA, 20 nt, Artificial Sequence
  Guide Sequence
gaaaggauuggggugggguc

SEQ ID NO: 15024 - RNA, 20 nt, Artificial Sequence
  Guide Sequence
gaaggggccgugggaaguaa

SEQ ID NO: 15025 - RNA, 20 nt, Artificial Sequence
  Guide Sequence
gaaguaacgggggguaccac

SEQ ID NO: 15026 - RNA, 20 nt, Artificial Sequence
  Guide Sequence
gacccgcaggagccggagcc

SEQ ID NO: 15027 - RNA, 20 nt, Artificial Sequence
  Guide Sequence
gacugagguucaaaacgggu

SEQ ID NO: 15028 - RNA, 20 nt, Artificial Sequence
  Guide Sequence
gagaggccgugggcgucggu

SEQ ID NO: 15029 - RNA, 20 nt, Artificial Sequence
  Guide Sequence
gagaugacugaaucgugcuu

SEQ ID NO: 15030 - RNA, 20 nt, Artificial Sequence
  Guide Sequence
gagcccggcguugaaggggc

SEQ ID NO: 15031 - RNA, 20 nt, Artificial Sequence
  Guide Sequence
gagccggagcccggcguuga

SEQ ID NO: 15032 - RNA, 20 nt, Artificial Sequence
  Guide Sequence
gagcgaaaggauuggggugg

SEQ ID NO: 15033 - RNA, 20 nt, Artificial Sequence
  Guide Sequence
gagcuccuucagacccgcag

SEQ ID NO: 15034 - RNA, 20 nt, Artificial Sequence
  Guide Sequence
gaggccgugggcgucgguga

SEQ ID NO: 15035 - RNA, 20 nt, Artificial Sequence
  Guide Sequence
gaggccuggcuuguguuccg

SEQ ID NO: 15036 - RNA, 20 nt, Artificial Sequence
  Guide Sequence
gaggcugucgccuuggccug

SEQ ID NO: 15037 - RNA, 20 nt, Artificial Sequence
  Guide Sequence
gaggcuuguuuggggccucc

SEQ ID NO: 15038 - RNA, 20 nt, Artificial Sequence
  Guide Sequence
gagggcauuugggauauggg

SEQ ID NO: 15039 - RNA, 20 nt, Artificial Sequence
  Guide Sequence
gaggggagggcauuugggau

SEQ ID NO: 15040 - RNA, 20 nt, Artificial Sequence
  Guide Sequence
gagguucaaaacggguggag

SEQ ID NO: 15041 - RNA, 20 nt, Artificial Sequence
  Guide Sequence
gaguggggucgcgcaggauc

SEQ ID NO: 15042 - RNA, 20 nt, Artificial Sequence
  Guide Sequence
gaguuuggggacugagguuc

SEQ ID NO: 15043 - RNA, 20 nt, Artificial Sequence
  Guide Sequence
gauaugggguaguuugugga

SEQ ID NO: 15044 - RNA, 20 nt, Artificial Sequence
  Guide Sequence
gauccagagaggccgugggc

SEQ ID NO: 15045 - RNA, 20 nt, Artificial Sequence
  Guide Sequence
gauccucacacgcaggggcc

SEQ ID NO: 15046 - RNA, 20 nt, Artificial Sequence
  Guide Sequence
gaugcgcuggagcgaaagga

SEQ ID NO: 15047 - RNA, 20 nt, Artificial Sequence
  Guide Sequence
gauuggggugggguccgugc

SEQ ID NO: 15048 - RNA, 20 nt, Artificial Sequence
  Guide Sequence
gcacagcauaguuguguuga

SEQ ID NO: 15049 - RNA, 20 nt, Artificial Sequence
  Guide Sequence
gcaggauccucacacgcagg

SEQ ID NO: 15050 - RNA, 20 nt, Artificial Sequence
  Guide Sequence
gcaggggccgggcucuguua

SEQ ID NO: 15051 - RNA, 20 nt, Artificial Sequence
  Guide Sequence
gcagucgucucugccaggcc

SEQ ID NO: 15052 - RNA, 20 nt, Artificial Sequence
  Guide Sequence
gcauaguuguguugagggga

SEQ ID NO: 15053 - RNA, 20 nt, Artificial Sequence
  Guide Sequence
gcauuugggauaugggguag

SEQ ID NO: 15054 - RNA, 20 nt, Artificial Sequence
  Guide Sequence
gccaggccuguguucacaug

SEQ ID NO: 15055 - RNA, 20 nt, Artificial Sequence
  Guide Sequence
gcccaucugagccccagugu

SEQ ID NO: 15056 - RNA, 20 nt, Artificial Sequence
  Guide Sequence
gcccggcguugaaggggccg

SEQ ID NO: 15057 - RNA, 20 nt, Artificial Sequence
  Guide Sequence
gccggagcccggcguugaag

SEQ ID NO: 15058 - RNA, 20 nt, Artificial Sequence
  Guide Sequence
gccgggcucuguuagugcga

SEQ ID NO: 15059 - RNA, 20 nt, Artificial Sequence
  Guide Sequence
gccgugggaaguaacggggg

SEQ ID NO: 15060 - RNA, 20 nt, Artificial Sequence
  Guide Sequence
gccgugggcgucggugagcu

SEQ ID NO: 15061 - RNA, 20 nt, Artificial Sequence
  Guide Sequence
gccuccguggcuccuuucag

SEQ ID NO: 15062 - RNA, 20 nt, Artificial Sequence
  Guide Sequence
gccucucuuuguacucuggg

SEQ ID NO: 15063 - RNA, 20 nt, Artificial Sequence
  Guide Sequence
gccugcccaucugagcccca

SEQ ID NO: 15064 - RNA, 20 nt, Artificial Sequence
  Guide Sequence
gccuggcuuguguuccgguu

SEQ ID NO: 15065 - RNA, 20 nt, Artificial Sequence
  Guide Sequence
gccuguguucacaugcuuga

SEQ ID NO: 15066 - RNA, 20 nt, Artificial Sequence
  Guide Sequence
gccuuggccugcccaucuga

SEQ ID NO: 15067 - RNA, 20 nt, Artificial Sequence
  Guide Sequence
gcgaaaggauuggggugggg

SEQ ID NO: 15068 - RNA, 20 nt, Artificial Sequence
  Guide Sequence
gcgauccagagaggccgugg

SEQ ID NO: 15069 - RNA, 20 nt, Artificial Sequence
  Guide Sequence
gcgcaggauccucacacgca

SEQ ID NO: 15070 - RNA, 20 nt, Artificial Sequence
  Guide Sequence
gcgcuggagcgaaaggauug

SEQ ID NO: 15071 - RNA, 20 nt, Artificial Sequence
  Guide Sequence
gcgucggugagcuccuucag

SEQ ID NO: 15072 - RNA, 20 nt, Artificial Sequence
  Guide Sequence
gcgugaggccuggcuugugu

SEQ ID NO: 15073 - RNA, 20 nt, Artificial Sequence
  Guide Sequence
gcguugaaggggccguggga

SEQ ID NO: 15074 - RNA, 20 nt, Artificial Sequence
  Guide Sequence
gcuccuucagacccgcagga

SEQ ID NO: 15075 - RNA, 20 nt, Artificial Sequence
  Guide Sequence
gcuccuuucagcgugaggcc

SEQ ID NO: 15076 - RNA, 20 nt, Artificial Sequence
  Guide Sequence
gcucuguuagugcgauccag

SEQ ID NO: 15077 - RNA, 20 nt, Artificial Sequence
  Guide Sequence
gcucuuggcagucgucucug

SEQ ID NO: 15078 - RNA, 20 nt, Artificial Sequence
  Guide Sequence
gcuggagcgaaaggauuggg

SEQ ID NO: 15079 - RNA, 20 nt, Artificial Sequence
  Guide Sequence
gcugucgccuuggccugccc

SEQ ID NO: 15080 - RNA, 20 nt, Artificial Sequence
  Guide Sequence
gcuuguguuccgguuccagc

SEQ ID NO: 15081 - RNA, 20 nt, Artificial Sequence
  Guide Sequence
gcuuguuuggggccuccgug

SEQ ID NO: 15082 - RNA, 20 nt, Artificial Sequence
  Guide Sequence
ggaaguaacgggggguacca

SEQ ID NO: 15083 - RNA, 20 nt, Artificial Sequence
  Guide Sequence
ggacugagguucaaaacggg

SEQ ID NO: 15084 - RNA, 20 nt, Artificial Sequence
  Guide Sequence
ggagaugacugaaucgugcu

SEQ ID NO: 15085 - RNA, 20 nt, Artificial Sequence
  Guide Sequence
ggagcccggcguugaagggg

SEQ ID NO: 15086 - RNA, 20 nt, Artificial Sequence
  Guide Sequence
ggagccggagcccggcguug

SEQ ID NO: 15087 - RNA, 20 nt, Artificial Sequence
  Guide Sequence
ggagcgaaaggauuggggug

SEQ ID NO: 15088 - RNA, 20 nt, Artificial Sequence
  Guide Sequence
ggaggcugucgccuuggccu

SEQ ID NO: 15089 - RNA, 20 nt, Artificial Sequence
  Guide Sequence
ggagggcauuugggauaugg

SEQ ID NO: 15090 - RNA, 20 nt, Artificial Sequence
  Guide Sequence
ggaguggggucgcgcaggau

SEQ ID NO: 15091 - RNA, 20 nt, Artificial Sequence
  Guide Sequence
ggauaugggguaguuugugg

SEQ ID NO: 15092 - RNA, 20 nt, Artificial Sequence
  Guide Sequence
ggauccucacacgcaggggc

SEQ ID NO: 15093 - RNA, 20 nt, Artificial Sequence
  Guide Sequence
ggaugcgcuggagcgaaagg

SEQ ID NO: 15094 - RNA, 20 nt, Artificial Sequence
  Guide Sequence
ggauuggggugggguccgug

SEQ ID NO: 15095 - RNA, 20 nt, Artificial Sequence
  Guide Sequence
ggcacagcauaguuguguug

SEQ ID NO: 15096 - RNA, 20 nt, Artificial Sequence
  Guide Sequence
ggcagucgucucugccaggc

SEQ ID NO: 15097 - RNA, 20 nt, Artificial Sequence
  Guide Sequence
ggcauuugggauauggggua

SEQ ID NO: 15098 - RNA, 20 nt, Artificial Sequence
  Guide Sequence
ggccgggcucuguuagugcg

SEQ ID NO: 15099 - RNA, 20 nt, Artificial Sequence
  Guide Sequence
ggccgugggaaguaacgggg

SEQ ID NO: 15100 - RNA, 20 nt, Artificial Sequence
  Guide Sequence
ggccgugggcgucggugagc

SEQ ID NO: 15101 - RNA, 20 nt, Artificial Sequence
  Guide Sequence
ggccuccguggcuccuuuca

SEQ ID NO: 15102 - RNA, 20 nt, Artificial Sequence
  Guide Sequence
ggccugcccaucugagcccc

SEQ ID NO: 15103 - RNA, 20 nt, Artificial Sequence
  Guide Sequence
ggccuggcuuguguuccggu

SEQ ID NO: 15104 - RNA, 20 nt, Artificial Sequence
  Guide Sequence
ggccuguguucacaugcuug

SEQ ID NO: 15105 - RNA, 20 nt, Artificial Sequence
  Guide Sequence
ggcgucggugagcuccuuca

SEQ ID NO: 15106 - RNA, 20 nt, Artificial Sequence
  Guide Sequence
ggcguugaaggggccguggg

SEQ ID NO: 15107 - RNA, 20 nt, Artificial Sequence
  Guide Sequence
ggcuccuuucagcgugaggc

SEQ ID NO: 15108 - RNA, 20 nt, Artificial Sequence
  Guide Sequence
ggcucuguuagugcgaucca

SEQ ID NO: 15109 - RNA, 20 nt, Artificial Sequence
  Guide Sequence
ggcugucgccuuggccugcc

SEQ ID NO: 15110 - RNA, 20 nt, Artificial Sequence
  Guide Sequence
ggcuuguguuccgguuccag

SEQ ID NO: 15111 - RNA, 20 nt, Artificial Sequence
  Guide Sequence
ggcuuguuuggggccuccgu

SEQ ID NO: 15112 - RNA, 20 nt, Artificial Sequence
  Guide Sequence
gggaaguaacgggggguacc

SEQ ID NO: 15113 - RNA, 20 nt, Artificial Sequence
  Guide Sequence
gggacugagguucaaaacgg

SEQ ID NO: 15114 - RNA, 20 nt, Artificial Sequence
  Guide Sequence
gggagggcauuugggauaug

SEQ ID NO: 15115 - RNA, 20 nt, Artificial Sequence
  Guide Sequence
gggaguggggucgcgcagga

SEQ ID NO: 15116 - RNA, 20 nt, Artificial Sequence
  Guide Sequence
gggauaugggguaguuugug

SEQ ID NO: 15117 - RNA, 20 nt, Artificial Sequence
  Guide Sequence
gggcacagcauaguuguguu

SEQ ID NO: 15118 - RNA, 20 nt, Artificial Sequence
  Guide Sequence
gggcauuugggauauggggu

SEQ ID NO: 15119 - RNA, 20 nt, Artificial Sequence
  Guide Sequence
gggccgggcucuguuagugc

SEQ ID NO: 15120 - RNA, 20 nt, Artificial Sequence
  Guide Sequence
gggccgugggaaguaacggg

SEQ ID NO: 15121 - RNA, 20 nt, Artificial Sequence
  Guide Sequence
gggccuccguggcuccuuuc

SEQ ID NO: 15122 - RNA, 20 nt, Artificial Sequence
  Guide Sequence
gggcgucggugagcuccuuc

SEQ ID NO: 15123 - RNA, 20 nt, Artificial Sequence
  Guide Sequence
gggcucuguuagugcgaucc

SEQ ID NO: 15124 - RNA, 20 nt, Artificial Sequence
  Guide Sequence
ggggacugagguucaaaacg

SEQ ID NO: 15125 - RNA, 20 nt, Artificial Sequence
  Guide Sequence
ggggagggcauuugggauau

SEQ ID NO: 15126 - RNA, 20 nt, Artificial Sequence
  Guide Sequence
ggggaguggggucgcgcagg

SEQ ID NO: 15127 - RNA, 20 nt, Artificial Sequence
  Guide Sequence
ggggccgggcucuguuagug

SEQ ID NO: 15128 - RNA, 20 nt, Artificial Sequence
  Guide Sequence
ggggccgugggaaguaacgg

SEQ ID NO: 15129 - RNA, 20 nt, Artificial Sequence
  Guide Sequence
ggggccuccguggcuccuuu

SEQ ID NO: 15130 - RNA, 20 nt, Artificial Sequence
  Guide Sequence
gggggguaccacgguuuagg

SEQ ID NO: 15131 - RNA, 20 nt, Artificial Sequence
  Guide Sequence
ggggguaccacgguuuagga

SEQ ID NO: 15132 - RNA, 20 nt, Artificial Sequence
  Guide Sequence
gggguaccacgguuuaggau

SEQ ID NO: 15133 - RNA, 20 nt, Artificial Sequence
  Guide Sequence
gggguaguuuguggagauga

SEQ ID NO: 15134 - RNA, 20 nt, Artificial Sequence
  Guide Sequence
gggguccgugcucuuggcag

SEQ ID NO: 15135 - RNA, 20 nt, Artificial Sequence
  Guide Sequence
ggggucgcgcaggauccuca

SEQ ID NO: 15136 - RNA, 20 nt, Artificial Sequence
  Guide Sequence
ggggugggguccgugcucuu

SEQ ID NO: 15137 - RNA, 20 nt, Artificial Sequence
  Guide Sequence
ggguaccacgguuuaggaug

SEQ ID NO: 15138 - RNA, 20 nt, Artificial Sequence
  Guide Sequence
ggguaguuuguggagaugac

SEQ ID NO: 15139 - RNA, 20 nt, Artificial Sequence
  Guide Sequence
ggguccgugcucuuggcagu

SEQ ID NO: 15140 - RNA, 20 nt, Artificial Sequence
  Guide Sequence
gggucgcgcaggauccucac

SEQ ID NO: 15141 - RNA, 20 nt, Artificial Sequence
  Guide Sequence
ggguggaggcugucgccuug

SEQ ID NO: 15142 - RNA, 20 nt, Artificial Sequence
  Guide Sequence
gggugggguccgugcucuug

SEQ ID NO: 15143 - RNA, 20 nt, Artificial Sequence
  Guide Sequence
gguaccacgguuuaggaugc

SEQ ID NO: 15144 - RNA, 20 nt, Artificial Sequence
  Guide Sequence
gguaguuuguggagaugacu

SEQ ID NO: 15145 - RNA, 20 nt, Artificial Sequence
  Guide Sequence
gguccgugcucuuggcaguc

SEQ ID NO: 15146 - RNA, 20 nt, Artificial Sequence
  Guide Sequence
ggucgcgcaggauccucaca

SEQ ID NO: 15147 - RNA, 20 nt, Artificial Sequence
  Guide Sequence
ggugagcuccuucagacccg

SEQ ID NO: 15148 - RNA, 20 nt, Artificial Sequence
  Guide Sequence
gguggaggcugucgccuugg

SEQ ID NO: 15149 - RNA, 20 nt, Artificial Sequence
  Guide Sequence
ggugggguccgugcucuugg

SEQ ID NO: 15150 - RNA, 20 nt, Artificial Sequence
  Guide Sequence
gguucaaaacggguggaggc

SEQ ID NO: 15151 - RNA, 20 nt, Artificial Sequence
  Guide Sequence
gguuccagccucucuuugua

SEQ ID NO: 15152 - RNA, 20 nt, Artificial Sequence
  Guide Sequence
gguuuaggaugcgcuggagc

SEQ ID NO: 15153 - RNA, 20 nt, Artificial Sequence
  Guide Sequence
guaacgggggguaccacggu

SEQ ID NO: 15154 - RNA, 20 nt, Artificial Sequence
  Guide Sequence
guaccacgguuuaggaugcg

SEQ ID NO: 15155 - RNA, 20 nt, Artificial Sequence
  Guide Sequence
guacucugggcacagcauag

SEQ ID NO: 15156 - RNA, 20 nt, Artificial Sequence
  Guide Sequence
guaguuuguggagaugacug

SEQ ID NO: 15157 - RNA, 20 nt, Artificial Sequence
  Guide Sequence
guccgugcucuuggcagucg

SEQ ID NO: 15158 - RNA, 20 nt, Artificial Sequence
  Guide Sequence
gucgccuuggccugcccauc

SEQ ID NO: 15159 - RNA, 20 nt, Artificial Sequence
  Guide Sequence
gucgcgcaggauccucacac

SEQ ID NO: 15160 - RNA, 20 nt, Artificial Sequence
  Guide Sequence
gucggugagcuccuucagac

SEQ ID NO: 15161 - RNA, 20 nt, Artificial Sequence
  Guide Sequence
gucgucucugccaggccugu

SEQ ID NO: 15162 - RNA, 20 nt, Artificial Sequence
  Guide Sequence
gucucugccaggccuguguu

SEQ ID NO: 15163 - RNA, 20 nt, Artificial Sequence
  Guide Sequence
gugagcuccuucagacccgc

SEQ ID NO: 15164 - RNA, 20 nt, Artificial Sequence
  Guide Sequence
gugaggccuggcuuguguuc

SEQ ID NO: 15165 - RNA, 20 nt, Artificial Sequence
  Guide Sequence
gugaguuuggggacugaggu

SEQ ID NO: 15166 - RNA, 20 nt, Artificial Sequence
  Guide Sequence
gugcgauccagagaggccgu

SEQ ID NO: 15167 - RNA, 20 nt, Artificial Sequence
  Guide Sequence
gugcucuuggcagucgucuc

SEQ ID NO: 15168 - RNA, 20 nt, Artificial Sequence
  Guide Sequence
guggagaugacugaaucgug

SEQ ID NO: 15169 - RNA, 20 nt, Artificial Sequence
  Guide Sequence
guggaggcugucgccuuggc

SEQ ID NO: 15170 - RNA, 20 nt, Artificial Sequence
  Guide Sequence
guggcuccuuucagcgugag

SEQ ID NO: 15171 - RNA, 20 nt, Artificial Sequence
  Guide Sequence
gugggaaguaacggggggua

SEQ ID NO: 15172 - RNA, 20 nt, Artificial Sequence
  Guide Sequence
gugggcgucggugagcuccu

SEQ ID NO: 15173 - RNA, 20 nt, Artificial Sequence
  Guide Sequence
gugggguccgugcucuuggc

SEQ ID NO: 15174 - RNA, 20 nt, Artificial Sequence
  Guide Sequence
guggggucgcgcaggauccu

SEQ ID NO: 15175 - RNA, 20 nt, Artificial Sequence
  Guide Sequence
guguuccgguuccagccucu

SEQ ID NO: 15176 - RNA, 20 nt, Artificial Sequence
  Guide Sequence
guguugaggggagggcauuu

SEQ ID NO: 15177 - RNA, 20 nt, Artificial Sequence
  Guide Sequence
guuagugcgauccagagagg

SEQ ID NO: 15178 - RNA, 20 nt, Artificial Sequence
  Guide Sequence
guucaaaacggguggaggcu

SEQ ID NO: 15179 - RNA, 20 nt, Artificial Sequence
  Guide Sequence
guuccagccucucuuuguac

SEQ ID NO: 15180 - RNA, 20 nt, Artificial Sequence
  Guide Sequence
guuccgguuccagccucucu

SEQ ID NO: 15181 - RNA, 20 nt, Artificial Sequence
  Guide Sequence
guugaaggggccgugggaag

SEQ ID NO: 15182 - RNA, 20 nt, Artificial Sequence
  Guide Sequence
guugaggggagggcauuugg

SEQ ID NO: 15183 - RNA, 20 nt, Artificial Sequence
  Guide Sequence
guuguguugaggggagggca

SEQ ID NO: 15184 - RNA, 20 nt, Artificial Sequence
  Guide Sequence
guuuaggaugcgcuggagcg

SEQ ID NO: 15185 - RNA, 20 nt, Artificial Sequence
  Guide Sequence
guuuggggacugagguucaa

SEQ ID NO: 15186 - RNA, 20 nt, Artificial Sequence
  Guide Sequence
guuuggggccuccguggcuc

SEQ ID NO: 15187 - RNA, 20 nt, Artificial Sequence
  Guide Sequence
guuuguggagaugacugaau

SEQ ID NO: 15188 - RNA, 20 nt, Artificial Sequence
  Guide Sequence
uaacgggggguaccacgguu

SEQ ID NO: 15189 - RNA, 20 nt, Artificial Sequence
  Guide Sequence
uaccacgguuuaggaugcgc

SEQ ID NO: 15190 - RNA, 20 nt, Artificial Sequence
  Guide Sequence
uacucugggcacagcauagu

SEQ ID NO: 15191 - RNA, 20 nt, Artificial Sequence
  Guide Sequence
uaggaugcgcuggagcgaaa

SEQ ID NO: 15192 - RNA, 20 nt, Artificial Sequence
  Guide Sequence
uagugcgauccagagaggcc

SEQ ID NO: 15193 - RNA, 20 nt, Artificial Sequence
  Guide Sequence
uaguuguguugaggggaggg

SEQ ID NO: 15194 - RNA, 20 nt, Artificial Sequence
  Guide Sequence
uaguuuguggagaugacuga

SEQ ID NO: 15195 - RNA, 20 nt, Artificial Sequence
  Guide Sequence
uaugggguaguuuguggaga

SEQ ID NO: 15196 - RNA, 20 nt, Artificial Sequence
  Guide Sequence
ucaaaacggguggaggcugu

SEQ ID NO: 15197 - RNA, 20 nt, Artificial Sequence
  Guide Sequence
ucacacgcaggggccgggcu

SEQ ID NO: 15198 - RNA, 20 nt, Artificial Sequence
  Guide Sequence
ucacaugcuugacuuucucc

SEQ ID NO: 15199 - RNA, 20 nt, Artificial Sequence
  Guide Sequence
ucagacccgcaggagccgga

SEQ ID NO: 15200 - RNA, 20 nt, Artificial Sequence
  Guide Sequence
ucagcgugaggccuggcuug

SEQ ID NO: 15201 - RNA, 20 nt, Artificial Sequence
  Guide Sequence
uccagagaggccgugggcgu

SEQ ID NO: 15202 - RNA, 20 nt, Artificial Sequence
  Guide Sequence
uccagccucucuuuguacuc

SEQ ID NO: 15203 - RNA, 20 nt, Artificial Sequence
  Guide Sequence
uccgguuccagccucucuuu

SEQ ID NO: 15204 - RNA, 20 nt, Artificial Sequence
  Guide Sequence
uccgugcucuuggcagucgu

SEQ ID NO: 15205 - RNA, 20 nt, Artificial Sequence
  Guide Sequence
uccguggcuccuuucagcgu

SEQ ID NO: 15206 - RNA, 20 nt, Artificial Sequence
  Guide Sequence
uccucacacgcaggggccgg

SEQ ID NO: 15207 - RNA, 20 nt, Artificial Sequence
  Guide Sequence
uccuucagacccgcaggagc

SEQ ID NO: 15208 - RNA, 20 nt, Artificial Sequence
  Guide Sequence
uccuuucagcgugaggccug

SEQ ID NO: 15209 - RNA, 20 nt, Artificial Sequence
  Guide Sequence
ucgccuuggccugcccaucu

SEQ ID NO: 15210 - RNA, 20 nt, Artificial Sequence
  Guide Sequence
ucgcgcaggauccucacacg

SEQ ID NO: 15211 - RNA, 20 nt, Artificial Sequence
  Guide Sequence
ucggugagcuccuucagacc

SEQ ID NO: 15212 - RNA, 20 nt, Artificial Sequence
  Guide Sequence
ucgucucugccaggccugug

SEQ ID NO: 15213 - RNA, 20 nt, Artificial Sequence
  Guide Sequence
ucucugccaggccuguguuc

SEQ ID NO: 15214 - RNA, 20 nt, Artificial Sequence
  Guide Sequence
ucucuuuguacucugggcac

SEQ ID NO: 15215 - RNA, 20 nt, Artificial Sequence
  Guide Sequence
ucugccaggccuguguucac

SEQ ID NO: 15216 - RNA, 20 nt, Artificial Sequence
  Guide Sequence
ucugggcacagcauaguugu

SEQ ID NO: 15217 - RNA, 20 nt, Artificial Sequence
  Guide Sequence
ucuguuagugcgauccagag

SEQ ID NO: 15218 - RNA, 20 nt, Artificial Sequence
  Guide Sequence
ucuuggcagucgucucugcc

SEQ ID NO: 15219 - RNA, 20 nt, Artificial Sequence
  Guide Sequence
ucuuuguacucugggcacag

SEQ ID NO: 15220 - RNA, 20 nt, Artificial Sequence
  Guide Sequence
ugaaggggccgugggaagua

SEQ ID NO: 15221 - RNA, 20 nt, Artificial Sequence
  Guide Sequence
ugagcuccuucagacccgca

SEQ ID NO: 15222 - RNA, 20 nt, Artificial Sequence
  Guide Sequence
ugaggccuggcuuguguucc

SEQ ID NO: 15223 - RNA, 20 nt, Artificial Sequence
  Guide Sequence
ugaggggagggcauuuggga

SEQ ID NO: 15224 - RNA, 20 nt, Artificial Sequence
  Guide Sequence
ugagguucaaaacgggugga

SEQ ID NO: 15225 - RNA, 20 nt, Artificial Sequence
  Guide Sequence
ugaguuuggggacugagguu

SEQ ID NO: 15226 - RNA, 20 nt, Artificial Sequence
  Guide Sequence
ugccaggccuguguucacau

SEQ ID NO: 15227 - RNA, 20 nt, Artificial Sequence
  Guide Sequence
ugcccaucugagccccagug

SEQ ID NO: 15228 - RNA, 20 nt, Artificial Sequence
  Guide Sequence
ugcgauccagagaggccgug

SEQ ID NO: 15229 - RNA, 20 nt, Artificial Sequence
  Guide Sequence
ugcgcuggagcgaaaggauu

SEQ ID NO: 15230 - RNA, 20 nt, Artificial Sequence
  Guide Sequence
ugcucuuggcagucgucucu

SEQ ID NO: 15231 - RNA, 20 nt, Artificial Sequence
  Guide Sequence
uggagaugacugaaucgugc

SEQ ID NO: 15232 - RNA, 20 nt, Artificial Sequence
  Guide Sequence
uggagcgaaaggauuggggu

SEQ ID NO: 15233 - RNA, 20 nt, Artificial Sequence
  Guide Sequence
uggaggcugucgccuuggcc

SEQ ID NO: 15234 - RNA, 20 nt, Artificial Sequence
  Guide Sequence
uggcagucgucucugccagg

SEQ ID NO: 15235 - RNA, 20 nt, Artificial Sequence
  Guide Sequence
uggccugcccaucugagccc

SEQ ID NO: 15236 - RNA, 20 nt, Artificial Sequence
  Guide Sequence
uggcuccuuucagcgugagg

SEQ ID NO: 15237 - RNA, 20 nt, Artificial Sequence
  Guide Sequence
uggcuuguguuccgguucca

SEQ ID NO: 15238 - RNA, 20 nt, Artificial Sequence
  Guide Sequence
ugggaaguaacgggggguac

SEQ ID NO: 15239 - RNA, 20 nt, Artificial Sequence
  Guide Sequence
ugggauaugggguaguuugu

SEQ ID NO: 15240 - RNA, 20 nt, Artificial Sequence
  Guide Sequence
ugggcacagcauaguugugu

SEQ ID NO: 15241 - RNA, 20 nt, Artificial Sequence
  Guide Sequence
ugggcgucggugagcuccuu

SEQ ID NO: 15242 - RNA, 20 nt, Artificial Sequence
  Guide Sequence
uggggacugagguucaaaac

SEQ ID NO: 15243 - RNA, 20 nt, Artificial Sequence
  Guide Sequence
uggggccuccguggcuccuu

SEQ ID NO: 15244 - RNA, 20 nt, Artificial Sequence
  Guide Sequence
ugggguaguuuguggagaug

SEQ ID NO: 15245 - RNA, 20 nt, Artificial Sequence
  Guide Sequence
ugggguccgugcucuuggca

SEQ ID NO: 15246 - RNA, 20 nt, Artificial Sequence
  Guide Sequence
uggggucgcgcaggauccuc

SEQ ID NO: 15247 - RNA, 20 nt, Artificial Sequence
  Guide Sequence
uggggugggguccgugcucu

SEQ ID NO: 15248 - RNA, 20 nt, Artificial Sequence
  Guide Sequence
uguacucugggcacagcaua

SEQ ID NO: 15249 - RNA, 20 nt, Artificial Sequence
  Guide Sequence
ugucgccuuggccugcccau

SEQ ID NO: 15250 - RNA, 20 nt, Artificial Sequence
  Guide Sequence
uguggagaugacugaaucgu

SEQ ID NO: 15251 - RNA, 20 nt, Artificial Sequence
  Guide Sequence
uguguuccgguuccagccuc

SEQ ID NO: 15252 - RNA, 20 nt, Artificial Sequence
  Guide Sequence
uguguugaggggagggcauu

SEQ ID NO: 15253 - RNA, 20 nt, Artificial Sequence
  Guide Sequence
uguuagugcgauccagagag

SEQ ID NO: 15254 - RNA, 20 nt, Artificial Sequence
  Guide Sequence
uguuccgguuccagccucuc

SEQ ID NO: 15255 - RNA, 20 nt, Artificial Sequence
  Guide Sequence
uguugaggggagggcauuug

SEQ ID NO: 15256 - RNA, 20 nt, Artificial Sequence
  Guide Sequence
uguuuggggccuccguggcu

SEQ ID NO: 15257 - RNA, 20 nt, Artificial Sequence
  Guide Sequence
uuaggaugcgcuggagcgaa

SEQ ID NO: 15258 - RNA, 20 nt, Artificial Sequence
  Guide Sequence
uuagugcgauccagagaggc

SEQ ID NO: 15259 - RNA, 20 nt, Artificial Sequence
  Guide Sequence
uucaaaacggguggaggcug

SEQ ID NO: 15260 - RNA, 20 nt, Artificial Sequence
  Guide Sequence
uucacaugcuugacuuucuc

SEQ ID NO: 15261 - RNA, 20 nt, Artificial Sequence
  Guide Sequence
uucagacccgcaggagccgg

SEQ ID NO: 15262 - RNA, 20 nt, Artificial Sequence
  Guide Sequence
uucagcgugaggccuggcuu

SEQ ID NO: 15263 - RNA, 20 nt, Artificial Sequence
  Guide Sequence
uuccagccucucuuuguacu

SEQ ID NO: 15264 - RNA, 20 nt, Artificial Sequence
  Guide Sequence
uuccgguuccagccucucuu

SEQ ID NO: 15265 - RNA, 20 nt, Artificial Sequence
  Guide Sequence
uugaaggggccgugggaagu

SEQ ID NO: 15266 - RNA, 20 nt, Artificial Sequence
  Guide Sequence
uugaggggagggcauuuggg

SEQ ID NO: 15267 - RNA, 20 nt, Artificial Sequence
  Guide Sequence
uuggcagucgucucugccag

SEQ ID NO: 15268 - RNA, 20 nt, Artificial Sequence
  Guide Sequence
uuggccugcccaucugagcc

SEQ ID NO: 15269 - RNA, 20 nt, Artificial Sequence
  Guide Sequence
uugggauaugggguaguuug

SEQ ID NO: 15270 - RNA, 20 nt, Artificial Sequence
  Guide Sequence
uuggggacugagguucaaaa

SEQ ID NO: 15271 - RNA, 20 nt, Artificial Sequence
  Guide Sequence
uuggggccuccguggcuccu

SEQ ID NO: 15272 - RNA, 20 nt, Artificial Sequence
  Guide Sequence
uuggggugggguccgugcuc

SEQ ID NO: 15273 - RNA, 20 nt, Artificial Sequence
  Guide Sequence
uuguacucugggcacagcau

SEQ ID NO: 15274 - RNA, 20 nt, Artificial Sequence
  Guide Sequence
uuguggagaugacugaaucg

SEQ ID NO: 15275 - RNA, 20 nt, Artificial Sequence
  Guide Sequence
uuguguuccgguuccagccu

SEQ ID NO: 15276 - RNA, 20 nt, Artificial Sequence
  Guide Sequence
uuguguugaggggagggcau

SEQ ID NO: 15277 - RNA, 20 nt, Artificial Sequence
  Guide Sequence
uuguuuggggccuccguggc

SEQ ID NO: 15278 - RNA, 20 nt, Artificial Sequence
  Guide Sequence
uuuaggaugcgcuggagcga

SEQ ID NO: 15279 - RNA, 20 nt, Artificial Sequence
  Guide Sequence
uuucagcgugaggccuggcu

SEQ ID NO: 15280 - RNA, 20 nt, Artificial Sequence
  Guide Sequence
uuugggauaugggguaguuu

SEQ ID NO: 15281 - RNA, 20 nt, Artificial Sequence
  Guide Sequence
uuuggggacugagguucaaa

SEQ ID NO: 15282 - RNA, 20 nt, Artificial Sequence
  Guide Sequence
uuuggggccuccguggcucc

SEQ ID NO: 15283 - RNA, 20 nt, Artificial Sequence
  Guide Sequence
uuuguacucugggcacagca

SEQ ID NO: 15284 - RNA, 20 nt, Artificial Sequence
  Guide Sequence
uuuguggagaugacugaauc

SEQ ID NO: 15285 - RNA, 21 nt, Artificial Sequence
  Guide Sequence
aaaacggguggaggcugucgc

SEQ ID NO: 15286 - RNA, 21 nt, Artificial Sequence
  Guide Sequence
aaacggguggaggcugucgcc

SEQ ID NO: 15287 - RNA, 21 nt, Artificial Sequence
  Guide Sequence
aaaggauuggggugggguccg

SEQ ID NO: 15288 - RNA, 21 nt, Artificial Sequence
  Guide Sequence
aacgggggguaccacgguuua

SEQ ID NO: 15289 - RNA, 21 nt, Artificial Sequence
  Guide Sequence
aacggguggaggcugucgccu

SEQ ID NO: 15290 - RNA, 21 nt, Artificial Sequence
  Guide Sequence
aaggauuggggugggguccgu

SEQ ID NO: 15291 - RNA, 21 nt, Artificial Sequence
  Guide Sequence
aaggggccgugggaaguaacg

SEQ ID NO: 15292 - RNA, 21 nt, Artificial Sequence
  Guide Sequence
aaguaacgggggguaccacgg

SEQ ID NO: 15293 - RNA, 21 nt, Artificial Sequence
  Guide Sequence
acacgcaggggccgggcucug

SEQ ID NO: 15294 - RNA, 21 nt, Artificial Sequence
  Guide Sequence
acagcauaguuguguugaggg

SEQ ID NO: 15295 - RNA, 21 nt, Artificial Sequence
  Guide Sequence
accacgguuuaggaugcgcug

SEQ ID NO: 15296 - RNA, 21 nt, Artificial Sequence
  Guide Sequence
acgcaggggccgggcucuguu

SEQ ID NO: 15297 - RNA, 21 nt, Artificial Sequence
  Guide Sequence
acgggggguaccacgguuuag

SEQ ID NO: 15298 - RNA, 21 nt, Artificial Sequence
  Guide Sequence
acggguggaggcugucgccuu

SEQ ID NO: 15299 - RNA, 21 nt, Artificial Sequence
  Guide Sequence
acgguuuaggaugcgcuggag

SEQ ID NO: 15300 - RNA, 21 nt, Artificial Sequence
  Guide Sequence
acucugggcacagcauaguug

SEQ ID NO: 15301 - RNA, 21 nt, Artificial Sequence
  Guide Sequence
acugagguucaaaacgggugg

SEQ ID NO: 15302 - RNA, 21 nt, Artificial Sequence
  Guide Sequence
agacccgcaggagccggagcc

SEQ ID NO: 15303 - RNA, 21 nt, Artificial Sequence
  Guide Sequence
agagaggccgugggcgucggu

SEQ ID NO: 15304 - RNA, 21 nt, Artificial Sequence
  Guide Sequence
agaggccgugggcgucgguga

SEQ ID NO: 15305 - RNA, 21 nt, Artificial Sequence
  Guide Sequence
agcauaguuguguugagggga

SEQ ID NO: 15306 - RNA, 21 nt, Artificial Sequence
  Guide Sequence
agcccggcguugaaggggccg

SEQ ID NO: 15307 - RNA, 21 nt, Artificial Sequence
  Guide Sequence
agccggagcccggcguugaag

SEQ ID NO: 15308 - RNA, 21 nt, Artificial Sequence
  Guide Sequence
agccucucuuuguacucuggg

SEQ ID NO: 15309 - RNA, 21 nt, Artificial Sequence
  Guide Sequence
agcgaaaggauuggggugggg

SEQ ID NO: 15310 - RNA, 21 nt, Artificial Sequence
  Guide Sequence
agcgugaggccuggcuugugu

SEQ ID NO: 15311 - RNA, 21 nt, Artificial Sequence
  Guide Sequence
agcuccuucagacccgcagga

SEQ ID NO: 15312 - RNA, 21 nt, Artificial Sequence
  Guide Sequence
aggagccggagcccggcguug

SEQ ID NO: 15313 - RNA, 21 nt, Artificial Sequence
  Guide Sequence
aggauccucacacgcaggggc

SEQ ID NO: 15314 - RNA, 21 nt, Artificial Sequence
  Guide Sequence
aggaugcgcuggagcgaaagg

SEQ ID NO: 15315 - RNA, 21 nt, Artificial Sequence
  Guide Sequence
aggauuggggugggguccgug

SEQ ID NO: 15316 - RNA, 21 nt, Artificial Sequence
  Guide Sequence
aggccgugggcgucggugagc

SEQ ID NO: 15317 - RNA, 21 nt, Artificial Sequence
  Guide Sequence
aggccuggcuuguguuccggu

SEQ ID NO: 15318 - RNA, 21 nt, Artificial Sequence
  Guide Sequence
aggccuguguucacaugcuug

SEQ ID NO: 15319 - RNA, 21 nt, Artificial Sequence
  Guide Sequence
aggcugucgccuuggccugcc

SEQ ID NO: 15320 - RNA, 21 nt, Artificial Sequence
  Guide Sequence
aggcuuguuuggggccuccgu

SEQ ID NO: 15321 - RNA, 21 nt, Artificial Sequence
  Guide Sequence
agggcauuugggauauggggu

SEQ ID NO: 15322 - RNA, 21 nt, Artificial Sequence
  Guide Sequence
aggggagggcauuugggauau

SEQ ID NO: 15323 - RNA, 21 nt, Artificial Sequence
  Guide Sequence
aggggccgggcucuguuagug

SEQ ID NO: 15324 - RNA, 21 nt, Artificial Sequence
  Guide Sequence
aggggccgugggaaguaacgg

SEQ ID NO: 15325 - RNA, 21 nt, Artificial Sequence
  Guide Sequence
agguucaaaacggguggaggc

SEQ ID NO: 15326 - RNA, 21 nt, Artificial Sequence
  Guide Sequence
aguaacgggggguaccacggu

SEQ ID NO: 15327 - RNA, 21 nt, Artificial Sequence
  Guide Sequence
agucgucucugccaggccugu

SEQ ID NO: 15328 - RNA, 21 nt, Artificial Sequence
  Guide Sequence
agugaguuuggggacugaggu

SEQ ID NO: 15329 - RNA, 21 nt, Artificial Sequence
  Guide Sequence
agugcgauccagagaggccgu

SEQ ID NO: 15330 - RNA, 21 nt, Artificial Sequence
  Guide Sequence
aguggggucgcgcaggauccu

SEQ ID NO: 15331 - RNA, 21 nt, Artificial Sequence
  Guide Sequence
aguuguguugaggggagggca

SEQ ID NO: 15332 - RNA, 21 nt, Artificial Sequence
  Guide Sequence
aguuuggggacugagguucaa

SEQ ID NO: 15333 - RNA, 21 nt, Artificial Sequence
  Guide Sequence
aguuuguggagaugacugaau

SEQ ID NO: 15334 - RNA, 21 nt, Artificial Sequence
  Guide Sequence
auaguuguguugaggggaggg

SEQ ID NO: 15335 - RNA, 21 nt, Artificial Sequence
  Guide Sequence
auaugggguaguuuguggaga

SEQ ID NO: 15336 - RNA, 21 nt, Artificial Sequence
  Guide Sequence
auccagagaggccgugggcgu

SEQ ID NO: 15337 - RNA, 21 nt, Artificial Sequence
  Guide Sequence
auccucacacgcaggggccgg

SEQ ID NO: 15338 - RNA, 21 nt, Artificial Sequence
  Guide Sequence
augcgcuggagcgaaaggauu

SEQ ID NO: 15339 - RNA, 21 nt, Artificial Sequence
  Guide Sequence
augggguaguuuguggagaug

SEQ ID NO: 15340 - RNA, 21 nt, Artificial Sequence
  Guide Sequence
auuggggugggguccgugcuc

SEQ ID NO: 15341 - RNA, 21 nt, Artificial Sequence
  Guide Sequence
auuugggauaugggguaguuu

SEQ ID NO: 15342 - RNA, 21 nt, Artificial Sequence
  Guide Sequence
caaaacggguggaggcugucg

SEQ ID NO: 15343 - RNA, 21 nt, Artificial Sequence
  Guide Sequence
cacacgcaggggccgggcucu

SEQ ID NO: 15344 - RNA, 21 nt, Artificial Sequence
  Guide Sequence
cacagcauaguuguguugagg

SEQ ID NO: 15345 - RNA, 21 nt, Artificial Sequence
  Guide Sequence
cacgcaggggccgggcucugu

SEQ ID NO: 15346 - RNA, 21 nt, Artificial Sequence
  Guide Sequence
cacgguuuaggaugcgcugga

SEQ ID NO: 15347 - RNA, 21 nt, Artificial Sequence
  Guide Sequence
cagacccgcaggagccggagc

SEQ ID NO: 15348 - RNA, 21 nt, Artificial Sequence
  Guide Sequence
cagagaggccgugggcgucgg

SEQ ID NO: 15349 - RNA, 21 nt, Artificial Sequence
  Guide Sequence
cagcauaguuguguugagggg

SEQ ID NO: 15350 - RNA, 21 nt, Artificial Sequence
  Guide Sequence
cagccucucuuuguacucugg

SEQ ID NO: 15351 - RNA, 21 nt, Artificial Sequence
  Guide Sequence
cagcgugaggccuggcuugug

SEQ ID NO: 15352 - RNA, 21 nt, Artificial Sequence
  Guide Sequence
caggagccggagcccggcguu

SEQ ID NO: 15353 - RNA, 21 nt, Artificial Sequence
  Guide Sequence
caggauccucacacgcagggg

SEQ ID NO: 15354 - RNA, 21 nt, Artificial Sequence
  Guide Sequence
caggccuguguucacaugcuu

SEQ ID NO: 15355 - RNA, 21 nt, Artificial Sequence
  Guide Sequence
caggggccgggcucuguuagu

SEQ ID NO: 15356 - RNA, 21 nt, Artificial Sequence
  Guide Sequence
cagucgucucugccaggccug

SEQ ID NO: 15357 - RNA, 21 nt, Artificial Sequence
  Guide Sequence
cauaguuguguugaggggagg

SEQ ID NO: 15358 - RNA, 21 nt, Artificial Sequence
  Guide Sequence
cauuugggauaugggguaguu

SEQ ID NO: 15359 - RNA, 21 nt, Artificial Sequence
  Guide Sequence
ccacgguuuaggaugcgcugg

SEQ ID NO: 15360 - RNA, 21 nt, Artificial Sequence
  Guide Sequence
ccagagaggccgugggcgucg

SEQ ID NO: 15361 - RNA, 21 nt, Artificial Sequence
  Guide Sequence
ccagccucucuuuguacucug

SEQ ID NO: 15362 - RNA, 21 nt, Artificial Sequence
  Guide Sequence
ccaggccuguguucacaugcu

SEQ ID NO: 15363 - RNA, 21 nt, Artificial Sequence
  Guide Sequence
ccaucugagccccaguguuug

SEQ ID NO: 15364 - RNA, 21 nt, Artificial Sequence
  Guide Sequence
cccaucugagccccaguguuu

SEQ ID NO: 15365 - RNA, 21 nt, Artificial Sequence
  Guide Sequence
cccggcguugaaggggccgug

SEQ ID NO: 15366 - RNA, 21 nt, Artificial Sequence
  Guide Sequence
ccggagcccggcguugaaggg

SEQ ID NO: 15367 - RNA, 21 nt, Artificial Sequence
  Guide Sequence
ccggcguugaaggggccgugg

SEQ ID NO: 15368 - RNA, 21 nt, Artificial Sequence
  Guide Sequence
ccgggcucuguuagugcgauc

SEQ ID NO: 15369 - RNA, 21 nt, Artificial Sequence
  Guide Sequence
ccgguuccagccucucuuugu

SEQ ID NO: 15370 - RNA, 21 nt, Artificial Sequence
  Guide Sequence
ccgugcucuuggcagucgucu

SEQ ID NO: 15371 - RNA, 21 nt, Artificial Sequence
  Guide Sequence
ccguggcuccuuucagcguga

SEQ ID NO: 15372 - RNA, 21 nt, Artificial Sequence
  Guide Sequence
ccgugggaaguaacggggggu

SEQ ID NO: 15373 - RNA, 21 nt, Artificial Sequence
  Guide Sequence
ccgugggcgucggugagcucc

SEQ ID NO: 15374 - RNA, 21 nt, Artificial Sequence
  Guide Sequence
ccuccguggcuccuuucagcg

SEQ ID NO: 15375 - RNA, 21 nt, Artificial Sequence
  Guide Sequence
ccucucuuuguacucugggca

SEQ ID NO: 15376 - RNA, 21 nt, Artificial Sequence
  Guide Sequence
ccugcccaucugagccccagu

SEQ ID NO: 15377 - RNA, 21 nt, Artificial Sequence
  Guide Sequence
ccuggcuuguguuccgguucc

SEQ ID NO: 15378 - RNA, 21 nt, Artificial Sequence
  Guide Sequence
ccuucagacccgcaggagccg

SEQ ID NO: 15379 - RNA, 21 nt, Artificial Sequence
  Guide Sequence
ccuuggccugcccaucugagc

SEQ ID NO: 15380 - RNA, 21 nt, Artificial Sequence
  Guide Sequence
ccuuucagcgugaggccuggc

SEQ ID NO: 15381 - RNA, 21 nt, Artificial Sequence
  Guide Sequence
cgaaaggauuggggugggguc

SEQ ID NO: 15382 - RNA, 21 nt, Artificial Sequence
  Guide Sequence
cgaggcuuguuuggggccucc

SEQ ID NO: 15383 - RNA, 21 nt, Artificial Sequence
  Guide Sequence
cgauccagagaggccgugggc

SEQ ID NO: 15384 - RNA, 21 nt, Artificial Sequence
  Guide Sequence
cgcaggauccucacacgcagg

SEQ ID NO: 15385 - RNA, 21 nt, Artificial Sequence
  Guide Sequence
cgcaggggccgggcucuguua

SEQ ID NO: 15386 - RNA, 21 nt, Artificial Sequence
  Guide Sequence
cgccuuggccugcccaucuga

SEQ ID NO: 15387 - RNA, 21 nt, Artificial Sequence
  Guide Sequence
cgcgcaggauccucacacgca

SEQ ID NO: 15388 - RNA, 21 nt, Artificial Sequence
  Guide Sequence
cgcuggagcgaaaggauuggg

SEQ ID NO: 15389 - RNA, 21 nt, Artificial Sequence
  Guide Sequence
cggagcccggcguugaagggg

SEQ ID NO: 15390 - RNA, 21 nt, Artificial Sequence
  Guide Sequence
cggcguugaaggggccguggg

SEQ ID NO: 15391 - RNA, 21 nt, Artificial Sequence
  Guide Sequence
cgggcucuguuagugcgaucc

SEQ ID NO: 15392 - RNA, 21 nt, Artificial Sequence
  Guide Sequence
cgggggguaccacgguuuagg

SEQ ID NO: 15393 - RNA, 21 nt, Artificial Sequence
  Guide Sequence
cggguggaggcugucgccuug

SEQ ID NO: 15394 - RNA, 21 nt, Artificial Sequence
  Guide Sequence
cggugagcuccuucagacccg

SEQ ID NO: 15395 - RNA, 21 nt, Artificial Sequence
  Guide Sequence
cgguuccagccucucuuugua

SEQ ID NO: 15396 - RNA, 21 nt, Artificial Sequence
  Guide Sequence
cgguuuaggaugcgcuggagc

SEQ ID NO: 15397 - RNA, 21 nt, Artificial Sequence
  Guide Sequence
cgucggugagcuccuucagac

SEQ ID NO: 15398 - RNA, 21 nt, Artificial Sequence
  Guide Sequence
cgucucugccaggccuguguu

SEQ ID NO: 15399 - RNA, 21 nt, Artificial Sequence
  Guide Sequence
cgugaggccuggcuuguguuc

SEQ ID NO: 15400 - RNA, 21 nt, Artificial Sequence
  Guide Sequence
cgugcucuuggcagucgucuc

SEQ ID NO: 15401 - RNA, 21 nt, Artificial Sequence
  Guide Sequence
cguggcuccuuucagcgugag

SEQ ID NO: 15402 - RNA, 21 nt, Artificial Sequence
  Guide Sequence
cgugggaaguaacggggggua

SEQ ID NO: 15403 - RNA, 21 nt, Artificial Sequence
  Guide Sequence
cgugggcgucggugagcuccu

SEQ ID NO: 15404 - RNA, 21 nt, Artificial Sequence
  Guide Sequence
cguugaaggggccgugggaag

SEQ ID NO: 15405 - RNA, 21 nt, Artificial Sequence
  Guide Sequence
cucacacgcaggggccgggcu

SEQ ID NO: 15406 - RNA, 21 nt, Artificial Sequence
  Guide Sequence
cuccguggcuccuuucagcgu

SEQ ID NO: 15407 - RNA, 21 nt, Artificial Sequence
  Guide Sequence
cuccuucagacccgcaggagc

SEQ ID NO: 15408 - RNA, 21 nt, Artificial Sequence
  Guide Sequence
cuccuuucagcgugaggccug

SEQ ID NO: 15409 - RNA, 21 nt, Artificial Sequence
  Guide Sequence
cucucuuuguacucugggcac

SEQ ID NO: 15410 - RNA, 21 nt, Artificial Sequence
  Guide Sequence
cucugccaggccuguguucac

SEQ ID NO: 15411 - RNA, 21 nt, Artificial Sequence
  Guide Sequence
cucugggcacagcauaguugu

SEQ ID NO: 15412 - RNA, 21 nt, Artificial Sequence
  Guide Sequence
cucuguuagugcgauccagag

SEQ ID NO: 15413 - RNA, 21 nt, Artificial Sequence
  Guide Sequence
cucuuggcagucgucucugcc

SEQ ID NO: 15414 - RNA, 21 nt, Artificial Sequence
  Guide Sequence
cucuuuguacucugggcacag

SEQ ID NO: 15415 - RNA, 21 nt, Artificial Sequence
  Guide Sequence
cugagguucaaaacgggugga

SEQ ID NO: 15416 - RNA, 21 nt, Artificial Sequence
  Guide Sequence
cugccaggccuguguucacau

SEQ ID NO: 15417 - RNA, 21 nt, Artificial Sequence
  Guide Sequence
cugcccaucugagccccagug

SEQ ID NO: 15418 - RNA, 21 nt, Artificial Sequence
  Guide Sequence
cuggagcgaaaggauuggggu

SEQ ID NO: 15419 - RNA, 21 nt, Artificial Sequence
  Guide Sequence
cuggcuuguguuccgguucca

SEQ ID NO: 15420 - RNA, 21 nt, Artificial Sequence
  Guide Sequence
cugggcacagcauaguugugu

SEQ ID NO: 15421 - RNA, 21 nt, Artificial Sequence
  Guide Sequence
cugucgccuuggccugcccau

SEQ ID NO: 15422 - RNA, 21 nt, Artificial Sequence
  Guide Sequence
cuguuagugcgauccagagag

SEQ ID NO: 15423 - RNA, 21 nt, Artificial Sequence
  Guide Sequence
cuucagacccgcaggagccgg

SEQ ID NO: 15424 - RNA, 21 nt, Artificial Sequence
  Guide Sequence
cuuggcagucgucucugccag

SEQ ID NO: 15425 - RNA, 21 nt, Artificial Sequence
  Guide Sequence
cuuggccugcccaucugagcc

SEQ ID NO: 15426 - RNA, 21 nt, Artificial Sequence
  Guide Sequence
cuuguguuccgguuccagccu

SEQ ID NO: 15427 - RNA, 21 nt, Artificial Sequence
  Guide Sequence
cuuguuuggggccuccguggc

SEQ ID NO: 15428 - RNA, 21 nt, Artificial Sequence
  Guide Sequence
cuuucagcgugaggccuggcu

SEQ ID NO: 15429 - RNA, 21 nt, Artificial Sequence
  Guide Sequence
cuuuguacucugggcacagca

SEQ ID NO: 15430 - RNA, 21 nt, Artificial Sequence
  Guide Sequence
gaaaggauugggguggggucc

SEQ ID NO: 15431 - RNA, 21 nt, Artificial Sequence
  Guide Sequence
gaaggggccgugggaaguaac

SEQ ID NO: 15432 - RNA, 21 nt, Artificial Sequence
  Guide Sequence
gaaguaacgggggguaccacg

SEQ ID NO: 15433 - RNA, 21 nt, Artificial Sequence
  Guide Sequence
gacugagguucaaaacgggug

SEQ ID NO: 15434 - RNA, 21 nt, Artificial Sequence
  Guide Sequence
gagaggccgugggcgucggug

SEQ ID NO: 15435 - RNA, 21 nt, Artificial Sequence
  Guide Sequence
gagcccggcguugaaggggcc

SEQ ID NO: 15436 - RNA, 21 nt, Artificial Sequence
  Guide Sequence
gagccggagcccggcguugaa

SEQ ID NO: 15437 - RNA, 21 nt, Artificial Sequence
  Guide Sequence
gagcgaaaggauugggguggg

SEQ ID NO: 15438 - RNA, 21 nt, Artificial Sequence
  Guide Sequence
gagcuccuucagacccgcagg

SEQ ID NO: 15439 - RNA, 21 nt, Artificial Sequence
  Guide Sequence
gaggccgugggcgucggugag

SEQ ID NO: 15440 - RNA, 21 nt, Artificial Sequence
  Guide Sequence
gaggccuggcuuguguuccgg

SEQ ID NO: 15441 - RNA, 21 nt, Artificial Sequence
  Guide Sequence
gaggcugucgccuuggccugc

SEQ ID NO: 15442 - RNA, 21 nt, Artificial Sequence
  Guide Sequence
gaggcuuguuuggggccuccg

SEQ ID NO: 15443 - RNA, 21 nt, Artificial Sequence
  Guide Sequence
gagggcauuugggauaugggg

SEQ ID NO: 15444 - RNA, 21 nt, Artificial Sequence
  Guide Sequence
gaggggagggcauuugggaua

SEQ ID NO: 15445 - RNA, 21 nt, Artificial Sequence
  Guide Sequence
gagguucaaaacggguggagg

SEQ ID NO: 15446 - RNA, 21 nt, Artificial Sequence
  Guide Sequence
gaguggggucgcgcaggaucc

SEQ ID NO: 15447 - RNA, 21 nt, Artificial Sequence
  Guide Sequence
gaguuuggggacugagguuca

SEQ ID NO: 15448 - RNA, 21 nt, Artificial Sequence
  Guide Sequence
gauaugggguaguuuguggag

SEQ ID NO: 15449 - RNA, 21 nt, Artificial Sequence
  Guide Sequence
gauccagagaggccgugggcg

SEQ ID NO: 15450 - RNA, 21 nt, Artificial Sequence
  Guide Sequence
gauccucacacgcaggggccg

SEQ ID NO: 15451 - RNA, 21 nt, Artificial Sequence
  Guide Sequence
gaugcgcuggagcgaaaggau

SEQ ID NO: 15452 - RNA, 21 nt, Artificial Sequence
  Guide Sequence
gauuggggugggguccgugcu

SEQ ID NO: 15453 - RNA, 21 nt, Artificial Sequence
  Guide Sequence
gcacagcauaguuguguugag

SEQ ID NO: 15454 - RNA, 21 nt, Artificial Sequence
  Guide Sequence
gcaggauccucacacgcaggg

SEQ ID NO: 15455 - RNA, 21 nt, Artificial Sequence
  Guide Sequence
gcaggggccgggcucuguuag

SEQ ID NO: 15456 - RNA, 21 nt, Artificial Sequence
  Guide Sequence
gcagucgucucugccaggccu

SEQ ID NO: 15457 - RNA, 21 nt, Artificial Sequence
  Guide Sequence
gcauaguuguguugaggggag

SEQ ID NO: 15458 - RNA, 21 nt, Artificial Sequence
  Guide Sequence
gcauuugggauaugggguagu

SEQ ID NO: 15459 - RNA, 21 nt, Artificial Sequence
  Guide Sequence
gccaggccuguguucacaugc

SEQ ID NO: 15460 - RNA, 21 nt, Artificial Sequence
  Guide Sequence
gcccaucugagccccaguguu

SEQ ID NO: 15461 - RNA, 21 nt, Artificial Sequence
  Guide Sequence
gcccggcguugaaggggccgu

SEQ ID NO: 15462 - RNA, 21 nt, Artificial Sequence
  Guide Sequence
gccggagcccggcguugaagg

SEQ ID NO: 15463 - RNA, 21 nt, Artificial Sequence
  Guide Sequence
gccgggcucuguuagugcgau

SEQ ID NO: 15464 - RNA, 21 nt, Artificial Sequence
  Guide Sequence
gccgugggaaguaacgggggg

SEQ ID NO: 15465 - RNA, 21 nt, Artificial Sequence
  Guide Sequence
gccgugggcgucggugagcuc

SEQ ID NO: 15466 - RNA, 21 nt, Artificial Sequence
  Guide Sequence
gccuccguggcuccuuucagc

SEQ ID NO: 15467 - RNA, 21 nt, Artificial Sequence
  Guide Sequence
gccucucuuuguacucugggc

SEQ ID NO: 15468 - RNA, 21 nt, Artificial Sequence
  Guide Sequence
gccugcccaucugagccccag

SEQ ID NO: 15469 - RNA, 21 nt, Artificial Sequence
  Guide Sequence
gccuggcuuguguuccgguuc

SEQ ID NO: 15470 - RNA, 21 nt, Artificial Sequence
  Guide Sequence
gccuuggccugcccaucugag

SEQ ID NO: 15471 - RNA, 21 nt, Artificial Sequence
  Guide Sequence
gcgaaaggauugggguggggu

SEQ ID NO: 15472 - RNA, 21 nt, Artificial Sequence
  Guide Sequence
gcgauccagagaggccguggg

SEQ ID NO: 15473 - RNA, 21 nt, Artificial Sequence
  Guide Sequence
gcgcaggauccucacacgcag

SEQ ID NO: 15474 - RNA, 21 nt, Artificial Sequence
  Guide Sequence
gcgcuggagcgaaaggauugg

SEQ ID NO: 15475 - RNA, 21 nt, Artificial Sequence
  Guide Sequence
gcgucggugagcuccuucaga

SEQ ID NO: 15476 - RNA, 21 nt, Artificial Sequence
  Guide Sequence
gcgugaggccuggcuuguguu

SEQ ID NO: 15477 - RNA, 21 nt, Artificial Sequence
  Guide Sequence
gcguugaaggggccgugggaa

SEQ ID NO: 15478 - RNA, 21 nt, Artificial Sequence
  Guide Sequence
gcuccuucagacccgcaggag

SEQ ID NO: 15479 - RNA, 21 nt, Artificial Sequence
  Guide Sequence
gcuccuuucagcgugaggccu

SEQ ID NO: 15480 - RNA, 21 nt, Artificial Sequence
  Guide Sequence
gcucuguuagugcgauccaga

SEQ ID NO: 15481 - RNA, 21 nt, Artificial Sequence
  Guide Sequence
gcucuuggcagucgucucugc

SEQ ID NO: 15482 - RNA, 21 nt, Artificial Sequence
  Guide Sequence
gcuggagcgaaaggauugggg

SEQ ID NO: 15483 - RNA, 21 nt, Artificial Sequence
  Guide Sequence
gcugucgccuuggccugccca

SEQ ID NO: 15484 - RNA, 21 nt, Artificial Sequence
  Guide Sequence
gcuuguguuccgguuccagcc

SEQ ID NO: 15485 - RNA, 21 nt, Artificial Sequence
  Guide Sequence
gcuuguuuggggccuccgugg

SEQ ID NO: 15486 - RNA, 21 nt, Artificial Sequence
  Guide Sequence
ggaaguaacgggggguaccac

SEQ ID NO: 15487 - RNA, 21 nt, Artificial Sequence
  Guide Sequence
ggacugagguucaaaacgggu

SEQ ID NO: 15488 - RNA, 21 nt, Artificial Sequence
  Guide Sequence
ggagaugacugaaucgugcuu

SEQ ID NO: 15489 - RNA, 21 nt, Artificial Sequence
  Guide Sequence
ggagcccggcguugaaggggc

SEQ ID NO: 15490 - RNA, 21 nt, Artificial Sequence
  Guide Sequence
ggagccggagcccggcguuga

SEQ ID NO: 15491 - RNA, 21 nt, Artificial Sequence
  Guide Sequence
ggagcgaaaggauuggggugg

SEQ ID NO: 15492 - RNA, 21 nt, Artificial Sequence
  Guide Sequence
ggaggcugucgccuuggccug

SEQ ID NO: 15493 - RNA, 21 nt, Artificial Sequence
  Guide Sequence
ggagggcauuugggauauggg

SEQ ID NO: 15494 - RNA, 21 nt, Artificial Sequence
  Guide Sequence
ggaguggggucgcgcaggauc

SEQ ID NO: 15495 - RNA, 21 nt, Artificial Sequence
  Guide Sequence
ggauaugggguaguuugugga

SEQ ID NO: 15496 - RNA, 21 nt, Artificial Sequence
  Guide Sequence
ggauccucacacgcaggggcc

SEQ ID NO: 15497 - RNA, 21 nt, Artificial Sequence
  Guide Sequence
ggaugcgcuggagcgaaagga

SEQ ID NO: 15498 - RNA, 21 nt, Artificial Sequence
  Guide Sequence
ggauuggggugggguccgugc

SEQ ID NO: 15499 - RNA, 21 nt, Artificial Sequence
  Guide Sequence
ggcacagcauaguuguguuga

SEQ ID NO: 15500 - RNA, 21 nt, Artificial Sequence
  Guide Sequence
ggcagucgucucugccaggcc

SEQ ID NO: 15501 - RNA, 21 nt, Artificial Sequence
  Guide Sequence
ggcauuugggauaugggguag

SEQ ID NO: 15502 - RNA, 21 nt, Artificial Sequence
  Guide Sequence
ggccgggcucuguuagugcga

SEQ ID NO: 15503 - RNA, 21 nt, Artificial Sequence
  Guide Sequence
ggccgugggaaguaacggggg

SEQ ID NO: 15504 - RNA, 21 nt, Artificial Sequence
  Guide Sequence
ggccgugggcgucggugagcu

SEQ ID NO: 15505 - RNA, 21 nt, Artificial Sequence
  Guide Sequence
ggccuccguggcuccuuucag

SEQ ID NO: 15506 - RNA, 21 nt, Artificial Sequence
  Guide Sequence
ggccugcccaucugagcccca

SEQ ID NO: 15507 - RNA, 21 nt, Artificial Sequence
  Guide Sequence
ggccuggcuuguguuccgguu

SEQ ID NO: 15508 - RNA, 21 nt, Artificial Sequence
  Guide Sequence
ggccuguguucacaugcuuga

SEQ ID NO: 15509 - RNA, 21 nt, Artificial Sequence
  Guide Sequence
ggcgucggugagcuccuucag

SEQ ID NO: 15510 - RNA, 21 nt, Artificial Sequence
  Guide Sequence
ggcguugaaggggccguggga

SEQ ID NO: 15511 - RNA, 21 nt, Artificial Sequence
  Guide Sequence
ggcuccuuucagcgugaggcc

SEQ ID NO: 15512 - RNA, 21 nt, Artificial Sequence
  Guide Sequence
ggcucuguuagugcgauccag

SEQ ID NO: 15513 - RNA, 21 nt, Artificial Sequence
  Guide Sequence
ggcugucgccuuggccugccc

SEQ ID NO: 15514 - RNA, 21 nt, Artificial Sequence
  Guide Sequence
ggcuuguguuccgguuccagc

SEQ ID NO: 15515 - RNA, 21 nt, Artificial Sequence
  Guide Sequence
ggcuuguuuggggccuccgug

SEQ ID NO: 15516 - RNA, 21 nt, Artificial Sequence
  Guide Sequence
gggaaguaacgggggguacca

SEQ ID NO: 15517 - RNA, 21 nt, Artificial Sequence
  Guide Sequence
gggacugagguucaaaacggg

SEQ ID NO: 15518 - RNA, 21 nt, Artificial Sequence
  Guide Sequence
gggagggcauuugggauaugg

SEQ ID NO: 15519 - RNA, 21 nt, Artificial Sequence
  Guide Sequence
gggaguggggucgcgcaggau

SEQ ID NO: 15520 - RNA, 21 nt, Artificial Sequence
  Guide Sequence
gggauaugggguaguuugugg

SEQ ID NO: 15521 - RNA, 21 nt, Artificial Sequence
  Guide Sequence
gggcacagcauaguuguguug

SEQ ID NO: 15522 - RNA, 21 nt, Artificial Sequence
  Guide Sequence
gggcauuugggauauggggua

SEQ ID NO: 15523 - RNA, 21 nt, Artificial Sequence
  Guide Sequence
gggccgggcucuguuagugcg

SEQ ID NO: 15524 - RNA, 21 nt, Artificial Sequence
  Guide Sequence
gggccgugggaaguaacgggg

SEQ ID NO: 15525 - RNA, 21 nt, Artificial Sequence
  Guide Sequence
gggccuccguggcuccuuuca

SEQ ID NO: 15526 - RNA, 21 nt, Artificial Sequence
  Guide Sequence
gggcgucggugagcuccuuca

SEQ ID NO: 15527 - RNA, 21 nt, Artificial Sequence
  Guide Sequence
gggcucuguuagugcgaucca

SEQ ID NO: 15528 - RNA, 21 nt, Artificial Sequence
  Guide Sequence
ggggacugagguucaaaacgg

SEQ ID NO: 15529 - RNA, 21 nt, Artificial Sequence
  Guide Sequence
ggggagggcauuugggauaug

SEQ ID NO: 15530 - RNA, 21 nt, Artificial Sequence
  Guide Sequence
ggggaguggggucgcgcagga

SEQ ID NO: 15531 - RNA, 21 nt, Artificial Sequence
  Guide Sequence
ggggccgggcucuguuagugc

SEQ ID NO: 15532 - RNA, 21 nt, Artificial Sequence
  Guide Sequence
ggggccgugggaaguaacggg

SEQ ID NO: 15533 - RNA, 21 nt, Artificial Sequence
  Guide Sequence
ggggccuccguggcuccuuuc

SEQ ID NO: 15534 - RNA, 21 nt, Artificial Sequence
  Guide Sequence
gggggguaccacgguuuagga

SEQ ID NO: 15535 - RNA, 21 nt, Artificial Sequence
  Guide Sequence
ggggguaccacgguuuaggau

SEQ ID NO: 15536 - RNA, 21 nt, Artificial Sequence
  Guide Sequence
gggguaccacgguuuaggaug

SEQ ID NO: 15537 - RNA, 21 nt, Artificial Sequence
  Guide Sequence
gggguaguuuguggagaugac

SEQ ID NO: 15538 - RNA, 21 nt, Artificial Sequence
  Guide Sequence
gggguccgugcucuuggcagu

SEQ ID NO: 15539 - RNA, 21 nt, Artificial Sequence
  Guide Sequence
ggggucgcgcaggauccucac

SEQ ID NO: 15540 - RNA, 21 nt, Artificial Sequence
  Guide Sequence
ggggugggguccgugcucuug

SEQ ID NO: 15541 - RNA, 21 nt, Artificial Sequence
  Guide Sequence
ggguaccacgguuuaggaugc

SEQ ID NO: 15542 - RNA, 21 nt, Artificial Sequence
  Guide Sequence
ggguaguuuguggagaugacu

SEQ ID NO: 15543 - RNA, 21 nt, Artificial Sequence
  Guide Sequence
ggguccgugcucuuggcaguc

SEQ ID NO: 15544 - RNA, 21 nt, Artificial Sequence
  Guide Sequence
gggucgcgcaggauccucaca

SEQ ID NO: 15545 - RNA, 21 nt, Artificial Sequence
  Guide Sequence
ggguggaggcugucgccuugg

SEQ ID NO: 15546 - RNA, 21 nt, Artificial Sequence
  Guide Sequence
gggugggguccgugcucuugg

SEQ ID NO: 15547 - RNA, 21 nt, Artificial Sequence
  Guide Sequence
gguaccacgguuuaggaugcg

SEQ ID NO: 15548 - RNA, 21 nt, Artificial Sequence
  Guide Sequence
gguaguuuguggagaugacug

SEQ ID NO: 15549 - RNA, 21 nt, Artificial Sequence
  Guide Sequence
gguccgugcucuuggcagucg

SEQ ID NO: 15550 - RNA, 21 nt, Artificial Sequence
  Guide Sequence
ggucgcgcaggauccucacac

SEQ ID NO: 15551 - RNA, 21 nt, Artificial Sequence
  Guide Sequence
ggugagcuccuucagacccgc

SEQ ID NO: 15552 - RNA, 21 nt, Artificial Sequence
  Guide Sequence
gguggaggcugucgccuuggc

SEQ ID NO: 15553 - RNA, 21 nt, Artificial Sequence
  Guide Sequence
ggugggguccgugcucuuggc

SEQ ID NO: 15554 - RNA, 21 nt, Artificial Sequence
  Guide Sequence
gguucaaaacggguggaggcu

SEQ ID NO: 15555 - RNA, 21 nt, Artificial Sequence
  Guide Sequence
gguuccagccucucuuuguac

SEQ ID NO: 15556 - RNA, 21 nt, Artificial Sequence
  Guide Sequence
gguuuaggaugcgcuggagcg

SEQ ID NO: 15557 - RNA, 21 nt, Artificial Sequence
  Guide Sequence
guaacgggggguaccacgguu

SEQ ID NO: 15558 - RNA, 21 nt, Artificial Sequence
  Guide Sequence
guaccacgguuuaggaugcgc

SEQ ID NO: 15559 - RNA, 21 nt, Artificial Sequence
  Guide Sequence
guacucugggcacagcauagu

SEQ ID NO: 15560 - RNA, 21 nt, Artificial Sequence
  Guide Sequence
guaguuuguggagaugacuga

SEQ ID NO: 15561 - RNA, 21 nt, Artificial Sequence
  Guide Sequence
guccgugcucuuggcagucgu

SEQ ID NO: 15562 - RNA, 21 nt, Artificial Sequence
  Guide Sequence
gucgccuuggccugcccaucu

SEQ ID NO: 15563 - RNA, 21 nt, Artificial Sequence
  Guide Sequence
gucgcgcaggauccucacacg

SEQ ID NO: 15564 - RNA, 21 nt, Artificial Sequence
  Guide Sequence
gucggugagcuccuucagacc

SEQ ID NO: 15565 - RNA, 21 nt, Artificial Sequence
  Guide Sequence
gucgucucugccaggccugug

SEQ ID NO: 15566 - RNA, 21 nt, Artificial Sequence
  Guide Sequence
gucucugccaggccuguguuc

SEQ ID NO: 15567 - RNA, 21 nt, Artificial Sequence
  Guide Sequence
gugagcuccuucagacccgca

SEQ ID NO: 15568 - RNA, 21 nt, Artificial Sequence
  Guide Sequence
gugaggccuggcuuguguucc

SEQ ID NO: 15569 - RNA, 21 nt, Artificial Sequence
  Guide Sequence
gugaguuuggggacugagguu

SEQ ID NO: 15570 - RNA, 21 nt, Artificial Sequence
  Guide Sequence
gugcgauccagagaggccgug

SEQ ID NO: 15571 - RNA, 21 nt, Artificial Sequence
  Guide Sequence
gugcucuuggcagucgucucu

SEQ ID NO: 15572 - RNA, 21 nt, Artificial Sequence
  Guide Sequence
guggagaugacugaaucgugc

SEQ ID NO: 15573 - RNA, 21 nt, Artificial Sequence
  Guide Sequence
guggaggcugucgccuuggcc

SEQ ID NO: 15574 - RNA, 21 nt, Artificial Sequence
  Guide Sequence
guggcuccuuucagcgugagg

SEQ ID NO: 15575 - RNA, 21 nt, Artificial Sequence
  Guide Sequence
gugggaaguaacgggggguac

SEQ ID NO: 15576 - RNA, 21 nt, Artificial Sequence
  Guide Sequence
gugggcgucggugagcuccuu

SEQ ID NO: 15577 - RNA, 21 nt, Artificial Sequence
  Guide Sequence
gugggguccgugcucuuggca

SEQ ID NO: 15578 - RNA, 21 nt, Artificial Sequence
  Guide Sequence
guggggucgcgcaggauccuc

SEQ ID NO: 15579 - RNA, 21 nt, Artificial Sequence
  Guide Sequence
guguuccgguuccagccucuc

SEQ ID NO: 15580 - RNA, 21 nt, Artificial Sequence
  Guide Sequence
guguugaggggagggcauuug

SEQ ID NO: 15581 - RNA, 21 nt, Artificial Sequence
  Guide Sequence
guuagugcgauccagagaggc

SEQ ID NO: 15582 - RNA, 21 nt, Artificial Sequence
  Guide Sequence
guucaaaacggguggaggcug

SEQ ID NO: 15583 - RNA, 21 nt, Artificial Sequence
  Guide Sequence
guucacaugcuugacuuucuc

SEQ ID NO: 15584 - RNA, 21 nt, Artificial Sequence
  Guide Sequence
guuccagccucucuuuguacu

SEQ ID NO: 15585 - RNA, 21 nt, Artificial Sequence
  Guide Sequence
guuccgguuccagccucucuu

SEQ ID NO: 15586 - RNA, 21 nt, Artificial Sequence
  Guide Sequence
guugaaggggccgugggaagu

SEQ ID NO: 15587 - RNA, 21 nt, Artificial Sequence
  Guide Sequence
guugaggggagggcauuuggg

SEQ ID NO: 15588 - RNA, 21 nt, Artificial Sequence
  Guide Sequence
guuguguugaggggagggcau

SEQ ID NO: 15589 - RNA, 21 nt, Artificial Sequence
  Guide Sequence
guuuaggaugcgcuggagcga

SEQ ID NO: 15590 - RNA, 21 nt, Artificial Sequence
  Guide Sequence
guuuggggacugagguucaaa

SEQ ID NO: 15591 - RNA, 21 nt, Artificial Sequence
  Guide Sequence
guuuggggccuccguggcucc

SEQ ID NO: 15592 - RNA, 21 nt, Artificial Sequence
  Guide Sequence
guuuguggagaugacugaauc

SEQ ID NO: 15593 - RNA, 21 nt, Artificial Sequence
  Guide Sequence
uaacgggggguaccacgguuu

SEQ ID NO: 15594 - RNA, 21 nt, Artificial Sequence
  Guide Sequence
uaccacgguuuaggaugcgcu

SEQ ID NO: 15595 - RNA, 21 nt, Artificial Sequence
  Guide Sequence
uacucugggcacagcauaguu

SEQ ID NO: 15596 - RNA, 21 nt, Artificial Sequence
  Guide Sequence
uaggaugcgcuggagcgaaag

SEQ ID NO: 15597 - RNA, 21 nt, Artificial Sequence
  Guide Sequence
uagugcgauccagagaggccg

SEQ ID NO: 15598 - RNA, 21 nt, Artificial Sequence
  Guide Sequence
uaguuguguugaggggagggc

SEQ ID NO: 15599 - RNA, 21 nt, Artificial Sequence
  Guide Sequence
uaguuuguggagaugacugaa

SEQ ID NO: 15600 - RNA, 21 nt, Artificial Sequence
  Guide Sequence
uaugggguaguuuguggagau

SEQ ID NO: 15601 - RNA, 21 nt, Artificial Sequence
  Guide Sequence
ucaaaacggguggaggcuguc

SEQ ID NO: 15602 - RNA, 21 nt, Artificial Sequence
  Guide Sequence
ucacacgcaggggccgggcuc

SEQ ID NO: 15603 - RNA, 21 nt, Artificial Sequence
  Guide Sequence
ucagacccgcaggagccggag

SEQ ID NO: 15604 - RNA, 21 nt, Artificial Sequence
  Guide Sequence
ucagcgugaggccuggcuugu

SEQ ID NO: 15605 - RNA, 21 nt, Artificial Sequence
  Guide Sequence
uccagagaggccgugggcguc

SEQ ID NO: 15606 - RNA, 21 nt, Artificial Sequence
  Guide Sequence
uccagccucucuuuguacucu

SEQ ID NO: 15607 - RNA, 21 nt, Artificial Sequence
  Guide Sequence
uccgguuccagccucucuuug

SEQ ID NO: 15608 - RNA, 21 nt, Artificial Sequence
  Guide Sequence
uccgugcucuuggcagucguc

SEQ ID NO: 15609 - RNA, 21 nt, Artificial Sequence
  Guide Sequence
uccguggcuccuuucagcgug

SEQ ID NO: 15610 - RNA, 21 nt, Artificial Sequence
  Guide Sequence
uccucacacgcaggggccggg

SEQ ID NO: 15611 - RNA, 21 nt, Artificial Sequence
  Guide Sequence
uccuucagacccgcaggagcc

SEQ ID NO: 15612 - RNA, 21 nt, Artificial Sequence
  Guide Sequence
uccuuucagcgugaggccugg

SEQ ID NO: 15613 - RNA, 21 nt, Artificial Sequence
  Guide Sequence
ucgccuuggccugcccaucug

SEQ ID NO: 15614 - RNA, 21 nt, Artificial Sequence
  Guide Sequence
ucgcgcaggauccucacacgc

SEQ ID NO: 15615 - RNA, 21 nt, Artificial Sequence
  Guide Sequence
ucggugagcuccuucagaccc

SEQ ID NO: 15616 - RNA, 21 nt, Artificial Sequence
  Guide Sequence
ucgucucugccaggccugugu

SEQ ID NO: 15617 - RNA, 21 nt, Artificial Sequence
  Guide Sequence
ucucugccaggccuguguuca

SEQ ID NO: 15618 - RNA, 21 nt, Artificial Sequence
  Guide Sequence
ucucuuuguacucugggcaca

SEQ ID NO: 15619 - RNA, 21 nt, Artificial Sequence
  Guide Sequence
ucugccaggccuguguucaca

SEQ ID NO: 15620 - RNA, 21 nt, Artificial Sequence
  Guide Sequence
ucugggcacagcauaguugug

SEQ ID NO: 15621 - RNA, 21 nt, Artificial Sequence
  Guide Sequence
ucuguuagugcgauccagaga

SEQ ID NO: 15622 - RNA, 21 nt, Artificial Sequence
  Guide Sequence
ucuuggcagucgucucugcca

SEQ ID NO: 15623 - RNA, 21 nt, Artificial Sequence
  Guide Sequence
ucuuuguacucugggcacagc

SEQ ID NO: 15624 - RNA, 21 nt, Artificial Sequence
  Guide Sequence
ugaaggggccgugggaaguaa

SEQ ID NO: 15625 - RNA, 21 nt, Artificial Sequence
  Guide Sequence
ugagcuccuucagacccgcag

SEQ ID NO: 15626 - RNA, 21 nt, Artificial Sequence
  Guide Sequence
ugaggccuggcuuguguuccg

SEQ ID NO: 15627 - RNA, 21 nt, Artificial Sequence
  Guide Sequence
ugaggggagggcauuugggau

SEQ ID NO: 15628 - RNA, 21 nt, Artificial Sequence
  Guide Sequence
ugagguucaaaacggguggag

SEQ ID NO: 15629 - RNA, 21 nt, Artificial Sequence
  Guide Sequence
ugaguuuggggacugagguuc

SEQ ID NO: 15630 - RNA, 21 nt, Artificial Sequence
  Guide Sequence
ugccaggccuguguucacaug

SEQ ID NO: 15631 - RNA, 21 nt, Artificial Sequence
  Guide Sequence
ugcccaucugagccccagugu

SEQ ID NO: 15632 - RNA, 21 nt, Artificial Sequence
  Guide Sequence
ugcgauccagagaggccgugg

SEQ ID NO: 15633 - RNA, 21 nt, Artificial Sequence
  Guide Sequence
ugcgcuggagcgaaaggauug

SEQ ID NO: 15634 - RNA, 21 nt, Artificial Sequence
  Guide Sequence
ugcucuuggcagucgucucug

SEQ ID NO: 15635 - RNA, 21 nt, Artificial Sequence
  Guide Sequence
uggagaugacugaaucgugcu

SEQ ID NO: 15636 - RNA, 21 nt, Artificial Sequence
  Guide Sequence
uggagcgaaaggauuggggug

SEQ ID NO: 15637 - RNA, 21 nt, Artificial Sequence
  Guide Sequence
uggaggcugucgccuuggccu

SEQ ID NO: 15638 - RNA, 21 nt, Artificial Sequence
  Guide Sequence
uggcagucgucucugccaggc

SEQ ID NO: 15639 - RNA, 21 nt, Artificial Sequence
  Guide Sequence
uggccugcccaucugagcccc

SEQ ID NO: 15640 - RNA, 21 nt, Artificial Sequence
  Guide Sequence
uggcuccuuucagcgugaggc

SEQ ID NO: 15641 - RNA, 21 nt, Artificial Sequence
  Guide Sequence
uggcuuguguuccgguuccag

SEQ ID NO: 15642 - RNA, 21 nt, Artificial Sequence
  Guide Sequence
ugggaaguaacgggggguacc

SEQ ID NO: 15643 - RNA, 21 nt, Artificial Sequence
  Guide Sequence
ugggauaugggguaguuugug

SEQ ID NO: 15644 - RNA, 21 nt, Artificial Sequence
  Guide Sequence
ugggcacagcauaguuguguu

SEQ ID NO: 15645 - RNA, 21 nt, Artificial Sequence
  Guide Sequence
ugggcgucggugagcuccuuc

SEQ ID NO: 15646 - RNA, 21 nt, Artificial Sequence
  Guide Sequence
uggggacugagguucaaaacg

SEQ ID NO: 15647 - RNA, 21 nt, Artificial Sequence
  Guide Sequence
uggggccuccguggcuccuuu

SEQ ID NO: 15648 - RNA, 21 nt, Artificial Sequence
  Guide Sequence
ugggguaguuuguggagauga

SEQ ID NO: 15649 - RNA, 21 nt, Artificial Sequence
  Guide Sequence
ugggguccgugcucuuggcag

SEQ ID NO: 15650 - RNA, 21 nt, Artificial Sequence
  Guide Sequence
uggggucgcgcaggauccuca

SEQ ID NO: 15651 - RNA, 21 nt, Artificial Sequence
  Guide Sequence
uggggugggguccgugcucuu

SEQ ID NO: 15652 - RNA, 21 nt, Artificial Sequence
  Guide Sequence
uguacucugggcacagcauag

SEQ ID NO: 15653 - RNA, 21 nt, Artificial Sequence
  Guide Sequence
ugucgccuuggccugcccauc

SEQ ID NO: 15654 - RNA, 21 nt, Artificial Sequence
  Guide Sequence
uguggagaugacugaaucgug

SEQ ID NO: 15655 - RNA, 21 nt, Artificial Sequence
  Guide Sequence
uguguuccgguuccagccucu

SEQ ID NO: 15656 - RNA, 21 nt, Artificial Sequence
  Guide Sequence
uguguugaggggagggcauuu

SEQ ID NO: 15657 - RNA, 21 nt, Artificial Sequence
  Guide Sequence
uguuagugcgauccagagagg

SEQ ID NO: 15658 - RNA, 21 nt, Artificial Sequence
  Guide Sequence
uguuccgguuccagccucucu

SEQ ID NO: 15659 - RNA, 21 nt, Artificial Sequence
  Guide Sequence
uguugaggggagggcauuugg

SEQ ID NO: 15660 - RNA, 21 nt, Artificial Sequence
  Guide Sequence
uguuuggggccuccguggcuc

SEQ ID NO: 15661 - RNA, 21 nt, Artificial Sequence
  Guide Sequence
uuaggaugcgcuggagcgaaa

SEQ ID NO: 15662 - RNA, 21 nt, Artificial Sequence
  Guide Sequence
uuagugcgauccagagaggcc

SEQ ID NO: 15663 - RNA, 21 nt, Artificial Sequence
  Guide Sequence
uucaaaacggguggaggcugu

SEQ ID NO: 15664 - RNA, 21 nt, Artificial Sequence
  Guide Sequence
uucacaugcuugacuuucucc

SEQ ID NO: 15665 - RNA, 21 nt, Artificial Sequence
  Guide Sequence
uucagacccgcaggagccgga

SEQ ID NO: 15666 - RNA, 21 nt, Artificial Sequence
  Guide Sequence
uucagcgugaggccuggcuug

SEQ ID NO: 15667 - RNA, 21 nt, Artificial Sequence
  Guide Sequence
uuccagccucucuuuguacuc

SEQ ID NO: 15668 - RNA, 21 nt, Artificial Sequence
  Guide Sequence
uuccgguuccagccucucuuu

SEQ ID NO: 15669 - RNA, 21 nt, Artificial Sequence
  Guide Sequence
uugaaggggccgugggaagua

SEQ ID NO: 15670 - RNA, 21 nt, Artificial Sequence
  Guide Sequence
uugaggggagggcauuuggga

SEQ ID NO: 15671 - RNA, 21 nt, Artificial Sequence
  Guide Sequence
uuggcagucgucucugccagg

SEQ ID NO: 15672 - RNA, 21 nt, Artificial Sequence
  Guide Sequence
uuggccugcccaucugagccc

SEQ ID NO: 15673 - RNA, 21 nt, Artificial Sequence
  Guide Sequence
uugggauaugggguaguuugu

SEQ ID NO: 15674 - RNA, 21 nt, Artificial Sequence
  Guide Sequence
uuggggacugagguucaaaac

SEQ ID NO: 15675 - RNA, 21 nt, Artificial Sequence
  Guide Sequence
uuggggccuccguggcuccuu

SEQ ID NO: 15676 - RNA, 21 nt, Artificial Sequence
  Guide Sequence
uuggggugggguccgugcucu

SEQ ID NO: 15677 - RNA, 21 nt, Artificial Sequence
  Guide Sequence
uuguacucugggcacagcaua

SEQ ID NO: 15678 - RNA, 21 nt, Artificial Sequence
  Guide Sequence
uuguggagaugacugaaucgu

SEQ ID NO: 15679 - RNA, 21 nt, Artificial Sequence
  Guide Sequence
uuguguuccgguuccagccuc

SEQ ID NO: 15680 - RNA, 21 nt, Artificial Sequence
  Guide Sequence
uuguguugaggggagggcauu

SEQ ID NO: 15681 - RNA, 21 nt, Artificial Sequence
  Guide Sequence
uuguuuggggccuccguggcu

SEQ ID NO: 15682 - RNA, 21 nt, Artificial Sequence
  Guide Sequence
uuuaggaugcgcuggagcgaa

SEQ ID NO: 15683 - RNA, 21 nt, Artificial Sequence
  Guide Sequence
uuucagcgugaggccuggcuu

SEQ ID NO: 15684 - RNA, 21 nt, Artificial Sequence
  Guide Sequence
uuugggauaugggguaguuug

SEQ ID NO: 15685 - RNA, 21 nt, Artificial Sequence
  Guide Sequence
uuuggggacugagguucaaaa

SEQ ID NO: 15686 - RNA, 21 nt, Artificial Sequence
  Guide Sequence
uuuggggccuccguggcuccu

SEQ ID NO: 15687 - RNA, 21 nt, Artificial Sequence
  Guide Sequence
uuuguacucugggcacagcau

SEQ ID NO: 15688 - RNA, 21 nt, Artificial Sequence
  Guide Sequence
uuuguggagaugacugaaucg

SEQ ID NO: 15689 - RNA, 22 nt, Artificial Sequence
  Guide Sequence
aaaacggguggaggcugucgcc

SEQ ID NO: 15690 - RNA, 22 nt, Artificial Sequence
  Guide Sequence
aaacggguggaggcugucgccu

SEQ ID NO: 15691 - RNA, 22 nt, Artificial Sequence
  Guide Sequence
aaaggauuggggugggguccgu

SEQ ID NO: 15692 - RNA, 22 nt, Artificial Sequence
  Guide Sequence
aacgggggguaccacgguuuag

SEQ ID NO: 15693 - RNA, 22 nt, Artificial Sequence
  Guide Sequence
aacggguggaggcugucgccuu

SEQ ID NO: 15694 - RNA, 22 nt, Artificial Sequence
  Guide Sequence
aaggauuggggugggguccgug

SEQ ID NO: 15695 - RNA, 22 nt, Artificial Sequence
  Guide Sequence
aaggggccgugggaaguaacgg

SEQ ID NO: 15696 - RNA, 22 nt, Artificial Sequence
  Guide Sequence
aaguaacgggggguaccacggu

SEQ ID NO: 15697 - RNA, 22 nt, Artificial Sequence
  Guide Sequence
acacgcaggggccgggcucugu

SEQ ID NO: 15698 - RNA, 22 nt, Artificial Sequence
  Guide Sequence
acagcauaguuguguugagggg

SEQ ID NO: 15699 - RNA, 22 nt, Artificial Sequence
  Guide Sequence
accacgguuuaggaugcgcugg

SEQ ID NO: 15700 - RNA, 22 nt, Artificial Sequence
  Guide Sequence
acgcaggggccgggcucuguua

SEQ ID NO: 15701 - RNA, 22 nt, Artificial Sequence
  Guide Sequence
acgggggguaccacgguuuagg

SEQ ID NO: 15702 - RNA, 22 nt, Artificial Sequence
  Guide Sequence
acggguggaggcugucgccuug

SEQ ID NO: 15703 - RNA, 22 nt, Artificial Sequence
  Guide Sequence
acgguuuaggaugcgcuggagc

SEQ ID NO: 15704 - RNA, 22 nt, Artificial Sequence
  Guide Sequence
acucugggcacagcauaguugu

SEQ ID NO: 15705 - RNA, 22 nt, Artificial Sequence
  Guide Sequence
acugagguucaaaacgggugga

SEQ ID NO: 15706 - RNA, 22 nt, Artificial Sequence
  Guide Sequence
agacccgcaggagccggagccc

SEQ ID NO: 15707 - RNA, 22 nt, Artificial Sequence
  Guide Sequence
agagaggccgugggcgucggug

SEQ ID NO: 15708 - RNA, 22 nt, Artificial Sequence
  Guide Sequence
agaggccgugggcgucggugag

SEQ ID NO: 15709 - RNA, 22 nt, Artificial Sequence
  Guide Sequence
agcauaguuguguugaggggag

SEQ ID NO: 15710 - RNA, 22 nt, Artificial Sequence
  Guide Sequence
agcccggcguugaaggggccgu

SEQ ID NO: 15711 - RNA, 22 nt, Artificial Sequence
  Guide Sequence
agccggagcccggcguugaagg

SEQ ID NO: 15712 - RNA, 22 nt, Artificial Sequence
  Guide Sequence
agccucucuuuguacucugggc

SEQ ID NO: 15713 - RNA, 22 nt, Artificial Sequence
  Guide Sequence
agcgaaaggauugggguggggu

SEQ ID NO: 15714 - RNA, 22 nt, Artificial Sequence
  Guide Sequence
agcgugaggccuggcuuguguu

SEQ ID NO: 15715 - RNA, 22 nt, Artificial Sequence
  Guide Sequence
agcuccuucagacccgcaggag

SEQ ID NO: 15716 - RNA, 22 nt, Artificial Sequence
  Guide Sequence
aggagccggagcccggcguuga

SEQ ID NO: 15717 - RNA, 22 nt, Artificial Sequence
  Guide Sequence
aggauccucacacgcaggggcc

SEQ ID NO: 15718 - RNA, 22 nt, Artificial Sequence
  Guide Sequence
aggaugcgcuggagcgaaagga

SEQ ID NO: 15719 - RNA, 22 nt, Artificial Sequence
  Guide Sequence
aggauuggggugggguccgugc

SEQ ID NO: 15720 - RNA, 22 nt, Artificial Sequence
  Guide Sequence
aggccgugggcgucggugagcu

SEQ ID NO: 15721 - RNA, 22 nt, Artificial Sequence
  Guide Sequence
aggccuggcuuguguuccgguu

SEQ ID NO: 15722 - RNA, 22 nt, Artificial Sequence
  Guide Sequence
aggccuguguucacaugcuuga

SEQ ID NO: 15723 - RNA, 22 nt, Artificial Sequence
  Guide Sequence
aggcugucgccuuggccugccc

SEQ ID NO: 15724 - RNA, 22 nt, Artificial Sequence
  Guide Sequence
aggcuuguuuggggccuccgug

SEQ ID NO: 15725 - RNA, 22 nt, Artificial Sequence
  Guide Sequence
agggcauuugggauauggggua

SEQ ID NO: 15726 - RNA, 22 nt, Artificial Sequence
  Guide Sequence
aggggagggcauuugggauaug

SEQ ID NO: 15727 - RNA, 22 nt, Artificial Sequence
  Guide Sequence
aggggccgggcucuguuagugc

SEQ ID NO: 15728 - RNA, 22 nt, Artificial Sequence
  Guide Sequence
aggggccgugggaaguaacggg

SEQ ID NO: 15729 - RNA, 22 nt, Artificial Sequence
  Guide Sequence
agguucaaaacggguggaggcu

SEQ ID NO: 15730 - RNA, 22 nt, Artificial Sequence
  Guide Sequence
aguaacgggggguaccacgguu

SEQ ID NO: 15731 - RNA, 22 nt, Artificial Sequence
  Guide Sequence
agucgucucugccaggccugug

SEQ ID NO: 15732 - RNA, 22 nt, Artificial Sequence
  Guide Sequence
agugaguuuggggacugagguu

SEQ ID NO: 15733 - RNA, 22 nt, Artificial Sequence
  Guide Sequence
agugcgauccagagaggccgug

SEQ ID NO: 15734 - RNA, 22 nt, Artificial Sequence
  Guide Sequence
aguggggucgcgcaggauccuc

SEQ ID NO: 15735 - RNA, 22 nt, Artificial Sequence
  Guide Sequence
aguuguguugaggggagggcau

SEQ ID NO: 15736 - RNA, 22 nt, Artificial Sequence
  Guide Sequence
aguuuggggacugagguucaaa

SEQ ID NO: 15737 - RNA, 22 nt, Artificial Sequence
  Guide Sequence
aguuuguggagaugacugaauc

SEQ ID NO: 15738 - RNA, 22 nt, Artificial Sequence
  Guide Sequence
auaguuguguugaggggagggc

SEQ ID NO: 15739 - RNA, 22 nt, Artificial Sequence
  Guide Sequence
auaugggguaguuuguggagau

SEQ ID NO: 15740 - RNA, 22 nt, Artificial Sequence
  Guide Sequence
auccagagaggccgugggcguc

SEQ ID NO: 15741 - RNA, 22 nt, Artificial Sequence
  Guide Sequence
auccucacacgcaggggccggg

SEQ ID NO: 15742 - RNA, 22 nt, Artificial Sequence
  Guide Sequence
augcgcuggagcgaaaggauug

SEQ ID NO: 15743 - RNA, 22 nt, Artificial Sequence
  Guide Sequence
augggguaguuuguggagauga

SEQ ID NO: 15744 - RNA, 22 nt, Artificial Sequence
  Guide Sequence
auuggggugggguccgugcucu

SEQ ID NO: 15745 - RNA, 22 nt, Artificial Sequence
  Guide Sequence
auuugggauaugggguaguuug

SEQ ID NO: 15746 - RNA, 22 nt, Artificial Sequence
  Guide Sequence
caaaacggguggaggcugucgc

SEQ ID NO: 15747 - RNA, 22 nt, Artificial Sequence
  Guide Sequence
cacacgcaggggccgggcucug

SEQ ID NO: 15748 - RNA, 22 nt, Artificial Sequence
  Guide Sequence
cacagcauaguuguguugaggg

SEQ ID NO: 15749 - RNA, 22 nt, Artificial Sequence
  Guide Sequence
cacgcaggggccgggcucuguu

SEQ ID NO: 15750 - RNA, 22 nt, Artificial Sequence
  Guide Sequence
cacgguuuaggaugcgcuggag

SEQ ID NO: 15751 - RNA, 22 nt, Artificial Sequence
  Guide Sequence
cagacccgcaggagccggagcc

SEQ ID NO: 15752 - RNA, 22 nt, Artificial Sequence
  Guide Sequence
cagagaggccgugggcgucggu

SEQ ID NO: 15753 - RNA, 22 nt, Artificial Sequence
  Guide Sequence
cagcauaguuguguugagggga

SEQ ID NO: 15754 - RNA, 22 nt, Artificial Sequence
  Guide Sequence
cagccucucuuuguacucuggg

SEQ ID NO: 15755 - RNA, 22 nt, Artificial Sequence
  Guide Sequence
cagcgugaggccuggcuugugu

SEQ ID NO: 15756 - RNA, 22 nt, Artificial Sequence
  Guide Sequence
caggagccggagcccggcguug

SEQ ID NO: 15757 - RNA, 22 nt, Artificial Sequence
  Guide Sequence
caggauccucacacgcaggggc

SEQ ID NO: 15758 - RNA, 22 nt, Artificial Sequence
  Guide Sequence
caggccuguguucacaugcuug

SEQ ID NO: 15759 - RNA, 22 nt, Artificial Sequence
  Guide Sequence
caggggccgggcucuguuagug

SEQ ID NO: 15760 - RNA, 22 nt, Artificial Sequence
  Guide Sequence
cagucgucucugccaggccugu

SEQ ID NO: 15761 - RNA, 22 nt, Artificial Sequence
  Guide Sequence
cauaguuguguugaggggaggg

SEQ ID NO: 15762 - RNA, 22 nt, Artificial Sequence
  Guide Sequence
cauuugggauaugggguaguuu

SEQ ID NO: 15763 - RNA, 22 nt, Artificial Sequence
  Guide Sequence
ccacgguuuaggaugcgcugga

SEQ ID NO: 15764 - RNA, 22 nt, Artificial Sequence
  Guide Sequence
ccagagaggccgugggcgucgg

SEQ ID NO: 15765 - RNA, 22 nt, Artificial Sequence
  Guide Sequence
ccagccucucuuuguacucugg

SEQ ID NO: 15766 - RNA, 22 nt, Artificial Sequence
  Guide Sequence
ccaggccuguguucacaugcuu

SEQ ID NO: 15767 - RNA, 22 nt, Artificial Sequence
  Guide Sequence
cccaucugagccccaguguuug

SEQ ID NO: 15768 - RNA, 22 nt, Artificial Sequence
  Guide Sequence
cccggcguugaaggggccgugg

SEQ ID NO: 15769 - RNA, 22 nt, Artificial Sequence
  Guide Sequence
ccggagcccggcguugaagggg

SEQ ID NO: 15770 - RNA, 22 nt, Artificial Sequence
  Guide Sequence
ccggcguugaaggggccguggg

SEQ ID NO: 15771 - RNA, 22 nt, Artificial Sequence
  Guide Sequence
ccgggcucuguuagugcgaucc

SEQ ID NO: 15772 - RNA, 22 nt, Artificial Sequence
  Guide Sequence
ccgguuccagccucucuuugua

SEQ ID NO: 15773 - RNA, 22 nt, Artificial Sequence
  Guide Sequence
ccgugcucuuggcagucgucuc

SEQ ID NO: 15774 - RNA, 22 nt, Artificial Sequence
  Guide Sequence
ccguggcuccuuucagcgugag

SEQ ID NO: 15775 - RNA, 22 nt, Artificial Sequence
  Guide Sequence
ccgugggaaguaacggggggua

SEQ ID NO: 15776 - RNA, 22 nt, Artificial Sequence
  Guide Sequence
ccgugggcgucggugagcuccu

SEQ ID NO: 15777 - RNA, 22 nt, Artificial Sequence
  Guide Sequence
ccucacacgcaggggccgggcu

SEQ ID NO: 15778 - RNA, 22 nt, Artificial Sequence
  Guide Sequence
ccuccguggcuccuuucagcgu

SEQ ID NO: 15779 - RNA, 22 nt, Artificial Sequence
  Guide Sequence
ccucucuuuguacucugggcac

SEQ ID NO: 15780 - RNA, 22 nt, Artificial Sequence
  Guide Sequence
ccugcccaucugagccccagug

SEQ ID NO: 15781 - RNA, 22 nt, Artificial Sequence
  Guide Sequence
ccuggcuuguguuccgguucca

SEQ ID NO: 15782 - RNA, 22 nt, Artificial Sequence
  Guide Sequence
ccuucagacccgcaggagccgg

SEQ ID NO: 15783 - RNA, 22 nt, Artificial Sequence
  Guide Sequence
ccuuggccugcccaucugagcc

SEQ ID NO: 15784 - RNA, 22 nt, Artificial Sequence
  Guide Sequence
ccuuucagcgugaggccuggcu

SEQ ID NO: 15785 - RNA, 22 nt, Artificial Sequence
  Guide Sequence
cgaaaggauugggguggggucc

SEQ ID NO: 15786 - RNA, 22 nt, Artificial Sequence
  Guide Sequence
cgaggcuuguuuggggccuccg

SEQ ID NO: 15787 - RNA, 22 nt, Artificial Sequence
  Guide Sequence
cgauccagagaggccgugggcg

SEQ ID NO: 15788 - RNA, 22 nt, Artificial Sequence
  Guide Sequence
cgcaggauccucacacgcaggg

SEQ ID NO: 15789 - RNA, 22 nt, Artificial Sequence
  Guide Sequence
cgcaggggccgggcucuguuag

SEQ ID NO: 15790 - RNA, 22 nt, Artificial Sequence
  Guide Sequence
cgccuuggccugcccaucugag

SEQ ID NO: 15791 - RNA, 22 nt, Artificial Sequence
  Guide Sequence
cgcgcaggauccucacacgcag

SEQ ID NO: 15792 - RNA, 22 nt, Artificial Sequence
  Guide Sequence
cgcuggagcgaaaggauugggg

SEQ ID NO: 15793 - RNA, 22 nt, Artificial Sequence
  Guide Sequence
cggagcccggcguugaaggggc

SEQ ID NO: 15794 - RNA, 22 nt, Artificial Sequence
  Guide Sequence
cggcguugaaggggccguggga

SEQ ID NO: 15795 - RNA, 22 nt, Artificial Sequence
  Guide Sequence
cgggcucuguuagugcgaucca

SEQ ID NO: 15796 - RNA, 22 nt, Artificial Sequence
  Guide Sequence
cgggggguaccacgguuuagga

SEQ ID NO: 15797 - RNA, 22 nt, Artificial Sequence
  Guide Sequence
cggguggaggcugucgccuugg

SEQ ID NO: 15798 - RNA, 22 nt, Artificial Sequence
  Guide Sequence
cggugagcuccuucagacccgc

SEQ ID NO: 15799 - RNA, 22 nt, Artificial Sequence
  Guide Sequence
cgguuccagccucucuuuguac

SEQ ID NO: 15800 - RNA, 22 nt, Artificial Sequence
  Guide Sequence
cgguuuaggaugcgcuggagcg

SEQ ID NO: 15801 - RNA, 22 nt, Artificial Sequence
  Guide Sequence
cgucggugagcuccuucagacc

SEQ ID NO: 15802 - RNA, 22 nt, Artificial Sequence
  Guide Sequence
cgucucugccaggccuguguuc

SEQ ID NO: 15803 - RNA, 22 nt, Artificial Sequence
  Guide Sequence
cgugaggccuggcuuguguucc

SEQ ID NO: 15804 - RNA, 22 nt, Artificial Sequence
  Guide Sequence
cgugcucuuggcagucgucucu

SEQ ID NO: 15805 - RNA, 22 nt, Artificial Sequence
  Guide Sequence
cguggcuccuuucagcgugagg

SEQ ID NO: 15806 - RNA, 22 nt, Artificial Sequence
  Guide Sequence
cgugggaaguaacgggggguac

SEQ ID NO: 15807 - RNA, 22 nt, Artificial Sequence
  Guide Sequence
cgugggcgucggugagcuccuu

SEQ ID NO: 15808 - RNA, 22 nt, Artificial Sequence
  Guide Sequence
cguugaaggggccgugggaagu

SEQ ID NO: 15809 - RNA, 22 nt, Artificial Sequence
  Guide Sequence
cucacacgcaggggccgggcuc

SEQ ID NO: 15810 - RNA, 22 nt, Artificial Sequence
  Guide Sequence
cuccguggcuccuuucagcgug

SEQ ID NO: 15811 - RNA, 22 nt, Artificial Sequence
  Guide Sequence
cuccuucagacccgcaggagcc

SEQ ID NO: 15812 - RNA, 22 nt, Artificial Sequence
  Guide Sequence
cuccuuucagcgugaggccugg

SEQ ID NO: 15813 - RNA, 22 nt, Artificial Sequence
  Guide Sequence
cucucuuuguacucugggcaca

SEQ ID NO: 15814 - RNA, 22 nt, Artificial Sequence
  Guide Sequence
cucugccaggccuguguucaca

SEQ ID NO: 15815 - RNA, 22 nt, Artificial Sequence
  Guide Sequence
cucugggcacagcauaguugug

SEQ ID NO: 15816 - RNA, 22 nt, Artificial Sequence
  Guide Sequence
cucuguuagugcgauccagaga

SEQ ID NO: 15817 - RNA, 22 nt, Artificial Sequence
  Guide Sequence
cucuuggcagucgucucugcca

SEQ ID NO: 15818 - RNA, 22 nt, Artificial Sequence
  Guide Sequence
cucuuuguacucugggcacagc

SEQ ID NO: 15819 - RNA, 22 nt, Artificial Sequence
  Guide Sequence
cugagguucaaaacggguggag

SEQ ID NO: 15820 - RNA, 22 nt, Artificial Sequence
  Guide Sequence
cugccaggccuguguucacaug

SEQ ID NO: 15821 - RNA, 22 nt, Artificial Sequence
  Guide Sequence
cugcccaucugagccccagugu

SEQ ID NO: 15822 - RNA, 22 nt, Artificial Sequence
  Guide Sequence
cuggagcgaaaggauuggggug

SEQ ID NO: 15823 - RNA, 22 nt, Artificial Sequence
  Guide Sequence
cuggcuuguguuccgguuccag

SEQ ID NO: 15824 - RNA, 22 nt, Artificial Sequence
  Guide Sequence
cugggcacagcauaguuguguu

SEQ ID NO: 15825 - RNA, 22 nt, Artificial Sequence
  Guide Sequence
cugucgccuuggccugcccauc

SEQ ID NO: 15826 - RNA, 22 nt, Artificial Sequence
  Guide Sequence
cuguuagugcgauccagagagg

SEQ ID NO: 15827 - RNA, 22 nt, Artificial Sequence
  Guide Sequence
cuucagacccgcaggagccgga

SEQ ID NO: 15828 - RNA, 22 nt, Artificial Sequence
  Guide Sequence
cuuggcagucgucucugccagg

SEQ ID NO: 15829 - RNA, 22 nt, Artificial Sequence
  Guide Sequence
cuuggccugcccaucugagccc

SEQ ID NO: 15830 - RNA, 22 nt, Artificial Sequence
  Guide Sequence
cuuguguuccgguuccagccuc

SEQ ID NO: 15831 - RNA, 22 nt, Artificial Sequence
  Guide Sequence
cuuguuuggggccuccguggcu

SEQ ID NO: 15832 - RNA, 22 nt, Artificial Sequence
  Guide Sequence
cuuucagcgugaggccuggcuu

SEQ ID NO: 15833 - RNA, 22 nt, Artificial Sequence
  Guide Sequence
cuuuguacucugggcacagcau

SEQ ID NO: 15834 - RNA, 22 nt, Artificial Sequence
  Guide Sequence
gaaaggauuggggugggguccg

SEQ ID NO: 15835 - RNA, 22 nt, Artificial Sequence
  Guide Sequence
gaaggggccgugggaaguaacg

SEQ ID NO: 15836 - RNA, 22 nt, Artificial Sequence
  Guide Sequence
gaaguaacgggggguaccacgg

SEQ ID NO: 15837 - RNA, 22 nt, Artificial Sequence
  Guide Sequence
gacugagguucaaaacgggugg

SEQ ID NO: 15838 - RNA, 22 nt, Artificial Sequence
  Guide Sequence
gagaggccgugggcgucgguga

SEQ ID NO: 15839 - RNA, 22 nt, Artificial Sequence
  Guide Sequence
gagcccggcguugaaggggccg

SEQ ID NO: 15840 - RNA, 22 nt, Artificial Sequence
  Guide Sequence
gagccggagcccggcguugaag

SEQ ID NO: 15841 - RNA, 22 nt, Artificial Sequence
  Guide Sequence
gagcgaaaggauuggggugggg

SEQ ID NO: 15842 - RNA, 22 nt, Artificial Sequence
  Guide Sequence
gagcuccuucagacccgcagga

SEQ ID NO: 15843 - RNA, 22 nt, Artificial Sequence
  Guide Sequence
gaggccgugggcgucggugagc

SEQ ID NO: 15844 - RNA, 22 nt, Artificial Sequence
  Guide Sequence
gaggccuggcuuguguuccggu

SEQ ID NO: 15845 - RNA, 22 nt, Artificial Sequence
  Guide Sequence
gaggcugucgccuuggccugcc

SEQ ID NO: 15846 - RNA, 22 nt, Artificial Sequence
  Guide Sequence
gaggcuuguuuggggccuccgu

SEQ ID NO: 15847 - RNA, 22 nt, Artificial Sequence
  Guide Sequence
gagggcauuugggauauggggu

SEQ ID NO: 15848 - RNA, 22 nt, Artificial Sequence
  Guide Sequence
gaggggagggcauuugggauau

SEQ ID NO: 15849 - RNA, 22 nt, Artificial Sequence
  Guide Sequence
gagguucaaaacggguggaggc

SEQ ID NO: 15850 - RNA, 22 nt, Artificial Sequence
  Guide Sequence
gaguggggucgcgcaggauccu

SEQ ID NO: 15851 - RNA, 22 nt, Artificial Sequence
  Guide Sequence
gaguuuggggacugagguucaa

SEQ ID NO: 15852 - RNA, 22 nt, Artificial Sequence
  Guide Sequence
gauaugggguaguuuguggaga

SEQ ID NO: 15853 - RNA, 22 nt, Artificial Sequence
  Guide Sequence
gauccagagaggccgugggcgu

SEQ ID NO: 15854 - RNA, 22 nt, Artificial Sequence
  Guide Sequence
gauccucacacgcaggggccgg

SEQ ID NO: 15855 - RNA, 22 nt, Artificial Sequence
  Guide Sequence
gaugcgcuggagcgaaaggauu

SEQ ID NO: 15856 - RNA, 22 nt, Artificial Sequence
  Guide Sequence
gauuggggugggguccgugcuc

SEQ ID NO: 15857 - RNA, 22 nt, Artificial Sequence
  Guide Sequence
gcacagcauaguuguguugagg

SEQ ID NO: 15858 - RNA, 22 nt, Artificial Sequence
  Guide Sequence
gcaggagccggagcccggcguu

SEQ ID NO: 15859 - RNA, 22 nt, Artificial Sequence
  Guide Sequence
gcaggauccucacacgcagggg

SEQ ID NO: 15860 - RNA, 22 nt, Artificial Sequence
  Guide Sequence
gcaggggccgggcucuguuagu

SEQ ID NO: 15861 - RNA, 22 nt, Artificial Sequence
  Guide Sequence
gcagucgucucugccaggccug

SEQ ID NO: 15862 - RNA, 22 nt, Artificial Sequence
  Guide Sequence
gcauaguuguguugaggggagg

SEQ ID NO: 15863 - RNA, 22 nt, Artificial Sequence
  Guide Sequence
gcauuugggauaugggguaguu

SEQ ID NO: 15864 - RNA, 22 nt, Artificial Sequence
  Guide Sequence
gccaggccuguguucacaugcu

SEQ ID NO: 15865 - RNA, 22 nt, Artificial Sequence
  Guide Sequence
gcccaucugagccccaguguuu

SEQ ID NO: 15866 - RNA, 22 nt, Artificial Sequence
  Guide Sequence
gcccggcguugaaggggccgug

SEQ ID NO: 15867 - RNA, 22 nt, Artificial Sequence
  Guide Sequence
gccggagcccggcguugaaggg

SEQ ID NO: 15868 - RNA, 22 nt, Artificial Sequence
  Guide Sequence
gccgggcucuguuagugcgauc

SEQ ID NO: 15869 - RNA, 22 nt, Artificial Sequence
  Guide Sequence
gccgugggaaguaacggggggu

SEQ ID NO: 15870 - RNA, 22 nt, Artificial Sequence
  Guide Sequence
gccgugggcgucggugagcucc

SEQ ID NO: 15871 - RNA, 22 nt, Artificial Sequence
  Guide Sequence
gccuccguggcuccuuucagcg

SEQ ID NO: 15872 - RNA, 22 nt, Artificial Sequence
  Guide Sequence
gccucucuuuguacucugggca

SEQ ID NO: 15873 - RNA, 22 nt, Artificial Sequence
  Guide Sequence
gccugcccaucugagccccagu

SEQ ID NO: 15874 - RNA, 22 nt, Artificial Sequence
  Guide Sequence
gccuggcuuguguuccgguucc

SEQ ID NO: 15875 - RNA, 22 nt, Artificial Sequence
  Guide Sequence
gccuuggccugcccaucugagc

SEQ ID NO: 15876 - RNA, 22 nt, Artificial Sequence
  Guide Sequence
gcgaaaggauuggggugggguc

SEQ ID NO: 15877 - RNA, 22 nt, Artificial Sequence
  Guide Sequence
gcgauccagagaggccgugggc

SEQ ID NO: 15878 - RNA, 22 nt, Artificial Sequence
  Guide Sequence
gcgcaggauccucacacgcagg

SEQ ID NO: 15879 - RNA, 22 nt, Artificial Sequence
  Guide Sequence
gcgcuggagcgaaaggauuggg

SEQ ID NO: 15880 - RNA, 22 nt, Artificial Sequence
  Guide Sequence
gcgucggugagcuccuucagac

SEQ ID NO: 15881 - RNA, 22 nt, Artificial Sequence
  Guide Sequence
gcgugaggccuggcuuguguuc

SEQ ID NO: 15882 - RNA, 22 nt, Artificial Sequence
  Guide Sequence
gcguugaaggggccgugggaag

SEQ ID NO: 15883 - RNA, 22 nt, Artificial Sequence
  Guide Sequence
gcuccuucagacccgcaggagc

SEQ ID NO: 15884 - RNA, 22 nt, Artificial Sequence
  Guide Sequence
gcuccuuucagcgugaggccug

SEQ ID NO: 15885 - RNA, 22 nt, Artificial Sequence
  Guide Sequence
gcucuguuagugcgauccagag

SEQ ID NO: 15886 - RNA, 22 nt, Artificial Sequence
  Guide Sequence
gcucuuggcagucgucucugcc

SEQ ID NO: 15887 - RNA, 22 nt, Artificial Sequence
  Guide Sequence
gcuggagcgaaaggauuggggu

SEQ ID NO: 15888 - RNA, 22 nt, Artificial Sequence
  Guide Sequence
gcugucgccuuggccugcccau

SEQ ID NO: 15889 - RNA, 22 nt, Artificial Sequence
  Guide Sequence
gcuuguguuccgguuccagccu

SEQ ID NO: 15890 - RNA, 22 nt, Artificial Sequence
  Guide Sequence
gcuuguuuggggccuccguggc

SEQ ID NO: 15891 - RNA, 22 nt, Artificial Sequence
  Guide Sequence
ggaaguaacgggggguaccacg

SEQ ID NO: 15892 - RNA, 22 nt, Artificial Sequence
  Guide Sequence
ggacugagguucaaaacgggug

SEQ ID NO: 15893 - RNA, 22 nt, Artificial Sequence
  Guide Sequence
ggagcccggcguugaaggggcc

SEQ ID NO: 15894 - RNA, 22 nt, Artificial Sequence
  Guide Sequence
ggagccggagcccggcguugaa

SEQ ID NO: 15895 - RNA, 22 nt, Artificial Sequence
  Guide Sequence
ggagcgaaaggauugggguggg

SEQ ID NO: 15896 - RNA, 22 nt, Artificial Sequence
  Guide Sequence
ggaggcugucgccuuggccugc

SEQ ID NO: 15897 - RNA, 22 nt, Artificial Sequence
  Guide Sequence
ggagggcauuugggauaugggg

SEQ ID NO: 15898 - RNA, 22 nt, Artificial Sequence
  Guide Sequence
ggaguggggucgcgcaggaucc

SEQ ID NO: 15899 - RNA, 22 nt, Artificial Sequence
  Guide Sequence
ggauaugggguaguuuguggag

SEQ ID NO: 15900 - RNA, 22 nt, Artificial Sequence
  Guide Sequence
ggauccucacacgcaggggccg

SEQ ID NO: 15901 - RNA, 22 nt, Artificial Sequence
  Guide Sequence
ggaugcgcuggagcgaaaggau

SEQ ID NO: 15902 - RNA, 22 nt, Artificial Sequence
  Guide Sequence
ggauuggggugggguccgugcu

SEQ ID NO: 15903 - RNA, 22 nt, Artificial Sequence
  Guide Sequence
ggcacagcauaguuguguugag

SEQ ID NO: 15904 - RNA, 22 nt, Artificial Sequence
  Guide Sequence
ggcagucgucucugccaggccu

SEQ ID NO: 15905 - RNA, 22 nt, Artificial Sequence
  Guide Sequence
ggcauuugggauaugggguagu

SEQ ID NO: 15906 - RNA, 22 nt, Artificial Sequence
  Guide Sequence
ggccgggcucuguuagugcgau

SEQ ID NO: 15907 - RNA, 22 nt, Artificial Sequence
  Guide Sequence
ggccgugggaaguaacgggggg

SEQ ID NO: 15908 - RNA, 22 nt, Artificial Sequence
  Guide Sequence
ggccgugggcgucggugagcuc

SEQ ID NO: 15909 - RNA, 22 nt, Artificial Sequence
  Guide Sequence
ggccuccguggcuccuuucagc

SEQ ID NO: 15910 - RNA, 22 nt, Artificial Sequence
  Guide Sequence
ggccugcccaucugagccccag

SEQ ID NO: 15911 - RNA, 22 nt, Artificial Sequence
  Guide Sequence
ggccuggcuuguguuccgguuc

SEQ ID NO: 15912 - RNA, 22 nt, Artificial Sequence
  Guide Sequence
ggcgucggugagcuccuucaga

SEQ ID NO: 15913 - RNA, 22 nt, Artificial Sequence
  Guide Sequence
ggcguugaaggggccgugggaa

SEQ ID NO: 15914 - RNA, 22 nt, Artificial Sequence
  Guide Sequence
ggcuccuuucagcgugaggccu

SEQ ID NO: 15915 - RNA, 22 nt, Artificial Sequence
  Guide Sequence
ggcucuguuagugcgauccaga

SEQ ID NO: 15916 - RNA, 22 nt, Artificial Sequence
  Guide Sequence
ggcugucgccuuggccugccca

SEQ ID NO: 15917 - RNA, 22 nt, Artificial Sequence
  Guide Sequence
ggcuuguguuccgguuccagcc

SEQ ID NO: 15918 - RNA, 22 nt, Artificial Sequence
  Guide Sequence
ggcuuguuuggggccuccgugg

SEQ ID NO: 15919 - RNA, 22 nt, Artificial Sequence
  Guide Sequence
gggaaguaacgggggguaccac

SEQ ID NO: 15920 - RNA, 22 nt, Artificial Sequence
  Guide Sequence
gggacugagguucaaaacgggu

SEQ ID NO: 15921 - RNA, 22 nt, Artificial Sequence
  Guide Sequence
gggagggcauuugggauauggg

SEQ ID NO: 15922 - RNA, 22 nt, Artificial Sequence
  Guide Sequence
gggaguggggucgcgcaggauc

SEQ ID NO: 15923 - RNA, 22 nt, Artificial Sequence
  Guide Sequence
gggauaugggguaguuugugga

SEQ ID NO: 15924 - RNA, 22 nt, Artificial Sequence
  Guide Sequence
gggcacagcauaguuguguuga

SEQ ID NO: 15925 - RNA, 22 nt, Artificial Sequence
  Guide Sequence
gggcauuugggauaugggguag

SEQ ID NO: 15926 - RNA, 22 nt, Artificial Sequence
  Guide Sequence
gggccgggcucuguuagugcga

SEQ ID NO: 15927 - RNA, 22 nt, Artificial Sequence
  Guide Sequence
gggccgugggaaguaacggggg

SEQ ID NO: 15928 - RNA, 22 nt, Artificial Sequence
  Guide Sequence
gggccuccguggcuccuuucag

SEQ ID NO: 15929 - RNA, 22 nt, Artificial Sequence
  Guide Sequence
gggcgucggugagcuccuucag

SEQ ID NO: 15930 - RNA, 22 nt, Artificial Sequence
  Guide Sequence
gggcucuguuagugcgauccag

SEQ ID NO: 15931 - RNA, 22 nt, Artificial Sequence
  Guide Sequence
ggggacugagguucaaaacggg

SEQ ID NO: 15932 - RNA, 22 nt, Artificial Sequence
  Guide Sequence
ggggagggcauuugggauaugg

SEQ ID NO: 15933 - RNA, 22 nt, Artificial Sequence
  Guide Sequence
ggggaguggggucgcgcaggau

SEQ ID NO: 15934 - RNA, 22 nt, Artificial Sequence
  Guide Sequence
ggggccgggcucuguuagugcg

SEQ ID NO: 15935 - RNA, 22 nt, Artificial Sequence
  Guide Sequence
ggggccgugggaaguaacgggg

SEQ ID NO: 15936 - RNA, 22 nt, Artificial Sequence
  Guide Sequence
ggggccuccguggcuccuuuca

SEQ ID NO: 15937 - RNA, 22 nt, Artificial Sequence
  Guide Sequence
gggggguaccacgguuuaggau

SEQ ID NO: 15938 - RNA, 22 nt, Artificial Sequence
  Guide Sequence
ggggguaccacgguuuaggaug

SEQ ID NO: 15939 - RNA, 22 nt, Artificial Sequence
  Guide Sequence
gggguaccacgguuuaggaugc

SEQ ID NO: 15940 - RNA, 22 nt, Artificial Sequence
  Guide Sequence
gggguaguuuguggagaugacu

SEQ ID NO: 15941 - RNA, 22 nt, Artificial Sequence
  Guide Sequence
gggguccgugcucuuggcaguc

SEQ ID NO: 15942 - RNA, 22 nt, Artificial Sequence
  Guide Sequence
ggggucgcgcaggauccucaca

SEQ ID NO: 15943 - RNA, 22 nt, Artificial Sequence
  Guide Sequence
ggggugggguccgugcucuugg

SEQ ID NO: 15944 - RNA, 22 nt, Artificial Sequence
  Guide Sequence
ggguaccacgguuuaggaugcg

SEQ ID NO: 15945 - RNA, 22 nt, Artificial Sequence
  Guide Sequence
ggguaguuuguggagaugacug

SEQ ID NO: 15946 - RNA, 22 nt, Artificial Sequence
  Guide Sequence
ggguccgugcucuuggcagucg

SEQ ID NO: 15947 - RNA, 22 nt, Artificial Sequence
  Guide Sequence
gggucgcgcaggauccucacac

SEQ ID NO: 15948 - RNA, 22 nt, Artificial Sequence
  Guide Sequence
ggguggaggcugucgccuuggc

SEQ ID NO: 15949 - RNA, 22 nt, Artificial Sequence
  Guide Sequence
gggugggguccgugcucuuggc

SEQ ID NO: 15950 - RNA, 22 nt, Artificial Sequence
  Guide Sequence
gguaccacgguuuaggaugcgc

SEQ ID NO: 15951 - RNA, 22 nt, Artificial Sequence
  Guide Sequence
gguaguuuguggagaugacuga

SEQ ID NO: 15952 - RNA, 22 nt, Artificial Sequence
  Guide Sequence
gguccgugcucuuggcagucgu

SEQ ID NO: 15953 - RNA, 22 nt, Artificial Sequence
  Guide Sequence
ggucgcgcaggauccucacacg

SEQ ID NO: 15954 - RNA, 22 nt, Artificial Sequence
  Guide Sequence
ggugagcuccuucagacccgca

SEQ ID NO: 15955 - RNA, 22 nt, Artificial Sequence
  Guide Sequence
gguggaggcugucgccuuggcc

SEQ ID NO: 15956 - RNA, 22 nt, Artificial Sequence
  Guide Sequence
ggugggguccgugcucuuggca

SEQ ID NO: 15957 - RNA, 22 nt, Artificial Sequence
  Guide Sequence
gguucaaaacggguggaggcug

SEQ ID NO: 15958 - RNA, 22 nt, Artificial Sequence
  Guide Sequence
gguuccagccucucuuuguacu

SEQ ID NO: 15959 - RNA, 22 nt, Artificial Sequence
  Guide Sequence
gguuuaggaugcgcuggagcga

SEQ ID NO: 15960 - RNA, 22 nt, Artificial Sequence
  Guide Sequence
guaacgggggguaccacgguuu

SEQ ID NO: 15961 - RNA, 22 nt, Artificial Sequence
  Guide Sequence
guaccacgguuuaggaugcgcu

SEQ ID NO: 15962 - RNA, 22 nt, Artificial Sequence
  Guide Sequence
guacucugggcacagcauaguu

SEQ ID NO: 15963 - RNA, 22 nt, Artificial Sequence
  Guide Sequence
guaguuuguggagaugacugaa

SEQ ID NO: 15964 - RNA, 22 nt, Artificial Sequence
  Guide Sequence
guccgugcucuuggcagucguc

SEQ ID NO: 15965 - RNA, 22 nt, Artificial Sequence
  Guide Sequence
gucgccuuggccugcccaucug

SEQ ID NO: 15966 - RNA, 22 nt, Artificial Sequence
  Guide Sequence
gucgcgcaggauccucacacgc

SEQ ID NO: 15967 - RNA, 22 nt, Artificial Sequence
  Guide Sequence
gucggugagcuccuucagaccc

SEQ ID NO: 15968 - RNA, 22 nt, Artificial Sequence
  Guide Sequence
gucgucucugccaggccugugu

SEQ ID NO: 15969 - RNA, 22 nt, Artificial Sequence
  Guide Sequence
gucucugccaggccuguguuca

SEQ ID NO: 15970 - RNA, 22 nt, Artificial Sequence
  Guide Sequence
gugagcuccuucagacccgcag

SEQ ID NO: 15971 - RNA, 22 nt, Artificial Sequence
  Guide Sequence
gugaggccuggcuuguguuccg

SEQ ID NO: 15972 - RNA, 22 nt, Artificial Sequence
  Guide Sequence
gugaguuuggggacugagguuc

SEQ ID NO: 15973 - RNA, 22 nt, Artificial Sequence
  Guide Sequence
gugcgauccagagaggccgugg

SEQ ID NO: 15974 - RNA, 22 nt, Artificial Sequence
  Guide Sequence
gugcucuuggcagucgucucug

SEQ ID NO: 15975 - RNA, 22 nt, Artificial Sequence
  Guide Sequence
guggagaugacugaaucgugcu

SEQ ID NO: 15976 - RNA, 22 nt, Artificial Sequence
  Guide Sequence
guggaggcugucgccuuggccu

SEQ ID NO: 15977 - RNA, 22 nt, Artificial Sequence
  Guide Sequence
guggcuccuuucagcgugaggc

SEQ ID NO: 15978 - RNA, 22 nt, Artificial Sequence
  Guide Sequence
gugggaaguaacgggggguacc

SEQ ID NO: 15979 - RNA, 22 nt, Artificial Sequence
  Guide Sequence
gugggcgucggugagcuccuuc

SEQ ID NO: 15980 - RNA, 22 nt, Artificial Sequence
  Guide Sequence
gugggguccgugcucuuggcag

SEQ ID NO: 15981 - RNA, 22 nt, Artificial Sequence
  Guide Sequence
guggggucgcgcaggauccuca

SEQ ID NO: 15982 - RNA, 22 nt, Artificial Sequence
  Guide Sequence
guguuccgguuccagccucucu

SEQ ID NO: 15983 - RNA, 22 nt, Artificial Sequence
  Guide Sequence
guguugaggggagggcauuugg

SEQ ID NO: 15984 - RNA, 22 nt, Artificial Sequence
  Guide Sequence
guuagugcgauccagagaggcc

SEQ ID NO: 15985 - RNA, 22 nt, Artificial Sequence
  Guide Sequence
guucaaaacggguggaggcugu

SEQ ID NO: 15986 - RNA, 22 nt, Artificial Sequence
  Guide Sequence
guucacaugcuugacuuucucc

SEQ ID NO: 15987 - RNA, 22 nt, Artificial Sequence
  Guide Sequence
guuccagccucucuuuguacuc

SEQ ID NO: 15988 - RNA, 22 nt, Artificial Sequence
  Guide Sequence
guuccgguuccagccucucuuu

SEQ ID NO: 15989 - RNA, 22 nt, Artificial Sequence
  Guide Sequence
guugaaggggccgugggaagua

SEQ ID NO: 15990 - RNA, 22 nt, Artificial Sequence
  Guide Sequence
guugaggggagggcauuuggga

SEQ ID NO: 15991 - RNA, 22 nt, Artificial Sequence
  Guide Sequence
guuguguugaggggagggcauu

SEQ ID NO: 15992 - RNA, 22 nt, Artificial Sequence
  Guide Sequence
guuuaggaugcgcuggagcgaa

SEQ ID NO: 15993 - RNA, 22 nt, Artificial Sequence
  Guide Sequence
guuuggggacugagguucaaaa

SEQ ID NO: 15994 - RNA, 22 nt, Artificial Sequence
  Guide Sequence
guuuggggccuccguggcuccu

SEQ ID NO: 15995 - RNA, 22 nt, Artificial Sequence
  Guide Sequence
guuuguggagaugacugaaucg

SEQ ID NO: 15996 - RNA, 22 nt, Artificial Sequence
  Guide Sequence
uaacgggggguaccacgguuua

SEQ ID NO: 15997 - RNA, 22 nt, Artificial Sequence
  Guide Sequence
uaccacgguuuaggaugcgcug

SEQ ID NO: 15998 - RNA, 22 nt, Artificial Sequence
  Guide Sequence
uacucugggcacagcauaguug

SEQ ID NO: 15999 - RNA, 22 nt, Artificial Sequence
  Guide Sequence
uaggaugcgcuggagcgaaagg

SEQ ID NO: 16000 - RNA, 22 nt, Artificial Sequence
  Guide Sequence
uagugcgauccagagaggccgu

SEQ ID NO: 16001 - RNA, 22 nt, Artificial Sequence
  Guide Sequence
uaguuguguugaggggagggca

SEQ ID NO: 16002 - RNA, 22 nt, Artificial Sequence
  Guide Sequence
uaguuuguggagaugacugaau

SEQ ID NO: 16003 - RNA, 22 nt, Artificial Sequence
  Guide Sequence
uaugggguaguuuguggagaug

SEQ ID NO: 16004 - RNA, 22 nt, Artificial Sequence
  Guide Sequence
ucaaaacggguggaggcugucg

SEQ ID NO: 16005 - RNA, 22 nt, Artificial Sequence
  Guide Sequence
ucacacgcaggggccgggcucu

SEQ ID NO: 16006 - RNA, 22 nt, Artificial Sequence
  Guide Sequence
ucagacccgcaggagccggagc

SEQ ID NO: 16007 - RNA, 22 nt, Artificial Sequence
  Guide Sequence
ucagcgugaggccuggcuugug

SEQ ID NO: 16008 - RNA, 22 nt, Artificial Sequence
  Guide Sequence
uccagagaggccgugggcgucg

SEQ ID NO: 16009 - RNA, 22 nt, Artificial Sequence
  Guide Sequence
uccagccucucuuuguacucug

SEQ ID NO: 16010 - RNA, 22 nt, Artificial Sequence
  Guide Sequence
uccgguuccagccucucuuugu

SEQ ID NO: 16011 - RNA, 22 nt, Artificial Sequence
  Guide Sequence
uccgugcucuuggcagucgucu

SEQ ID NO: 16012 - RNA, 22 nt, Artificial Sequence
  Guide Sequence
uccguggcuccuuucagcguga

SEQ ID NO: 16013 - RNA, 22 nt, Artificial Sequence
  Guide Sequence
uccucacacgcaggggccgggc

SEQ ID NO: 16014 - RNA, 22 nt, Artificial Sequence
  Guide Sequence
uccuucagacccgcaggagccg

SEQ ID NO: 16015 - RNA, 22 nt, Artificial Sequence
  Guide Sequence
uccuuucagcgugaggccuggc

SEQ ID NO: 16016 - RNA, 22 nt, Artificial Sequence
  Guide Sequence
ucgccuuggccugcccaucuga

SEQ ID NO: 16017 - RNA, 22 nt, Artificial Sequence
  Guide Sequence
ucgcgcaggauccucacacgca

SEQ ID NO: 16018 - RNA, 22 nt, Artificial Sequence
  Guide Sequence
ucggugagcuccuucagacccg

SEQ ID NO: 16019 - RNA, 22 nt, Artificial Sequence
  Guide Sequence
ucgucucugccaggccuguguu

SEQ ID NO: 16020 - RNA, 22 nt, Artificial Sequence
  Guide Sequence
ucucugccaggccuguguucac

SEQ ID NO: 16021 - RNA, 22 nt, Artificial Sequence
  Guide Sequence
ucucuuuguacucugggcacag

SEQ ID NO: 16022 - RNA, 22 nt, Artificial Sequence
  Guide Sequence
ucugccaggccuguguucacau

SEQ ID NO: 16023 - RNA, 22 nt, Artificial Sequence
  Guide Sequence
ucugggcacagcauaguugugu

SEQ ID NO: 16024 - RNA, 22 nt, Artificial Sequence
  Guide Sequence
ucuguuagugcgauccagagag

SEQ ID NO: 16025 - RNA, 22 nt, Artificial Sequence
  Guide Sequence
ucuuggcagucgucucugccag

SEQ ID NO: 16026 - RNA, 22 nt, Artificial Sequence
  Guide Sequence
ucuuuguacucugggcacagca

SEQ ID NO: 16027 - RNA, 22 nt, Artificial Sequence
  Guide Sequence
ugaaggggccgugggaaguaac

SEQ ID NO: 16028 - RNA, 22 nt, Artificial Sequence
  Guide Sequence
ugagcuccuucagacccgcagg

SEQ ID NO: 16029 - RNA, 22 nt, Artificial Sequence
  Guide Sequence
ugaggccuggcuuguguuccgg

SEQ ID NO: 16030 - RNA, 22 nt, Artificial Sequence
  Guide Sequence
ugaggggagggcauuugggaua

SEQ ID NO: 16031 - RNA, 22 nt, Artificial Sequence
  Guide Sequence
ugagguucaaaacggguggagg

SEQ ID NO: 16032 - RNA, 22 nt, Artificial Sequence
  Guide Sequence
ugaguuuggggacugagguuca

SEQ ID NO: 16033 - RNA, 22 nt, Artificial Sequence
  Guide Sequence
ugccaggccuguguucacaugc

SEQ ID NO: 16034 - RNA, 22 nt, Artificial Sequence
  Guide Sequence
ugcccaucugagccccaguguu

SEQ ID NO: 16035 - RNA, 22 nt, Artificial Sequence
  Guide Sequence
ugcgauccagagaggccguggg

SEQ ID NO: 16036 - RNA, 22 nt, Artificial Sequence
  Guide Sequence
ugcgcuggagcgaaaggauugg

SEQ ID NO: 16037 - RNA, 22 nt, Artificial Sequence
  Guide Sequence
ugcucuuggcagucgucucugc

SEQ ID NO: 16038 - RNA, 22 nt, Artificial Sequence
  Guide Sequence
uggagaugacugaaucgugcuu

SEQ ID NO: 16039 - RNA, 22 nt, Artificial Sequence
  Guide Sequence
uggagcgaaaggauuggggugg

SEQ ID NO: 16040 - RNA, 22 nt, Artificial Sequence
  Guide Sequence
uggaggcugucgccuuggccug

SEQ ID NO: 16041 - RNA, 22 nt, Artificial Sequence
  Guide Sequence
uggcagucgucucugccaggcc

SEQ ID NO: 16042 - RNA, 22 nt, Artificial Sequence
  Guide Sequence
uggccugcccaucugagcccca

SEQ ID NO: 16043 - RNA, 22 nt, Artificial Sequence
  Guide Sequence
uggcuccuuucagcgugaggcc

SEQ ID NO: 16044 - RNA, 22 nt, Artificial Sequence
  Guide Sequence
uggcuuguguuccgguuccagc

SEQ ID NO: 16045 - RNA, 22 nt, Artificial Sequence
  Guide Sequence
ugggaaguaacgggggguacca

SEQ ID NO: 16046 - RNA, 22 nt, Artificial Sequence
  Guide Sequence
ugggauaugggguaguuugugg

SEQ ID NO: 16047 - RNA, 22 nt, Artificial Sequence
  Guide Sequence
ugggcacagcauaguuguguug

SEQ ID NO: 16048 - RNA, 22 nt, Artificial Sequence
  Guide Sequence
ugggcgucggugagcuccuuca

SEQ ID NO: 16049 - RNA, 22 nt, Artificial Sequence
  Guide Sequence
uggggacugagguucaaaacgg

SEQ ID NO: 16050 - RNA, 22 nt, Artificial Sequence
  Guide Sequence
uggggccuccguggcuccuuuc

SEQ ID NO: 16051 - RNA, 22 nt, Artificial Sequence
  Guide Sequence
ugggguaguuuguggagaugac

SEQ ID NO: 16052 - RNA, 22 nt, Artificial Sequence
  Guide Sequence
ugggguccgugcucuuggcagu

SEQ ID NO: 16053 - RNA, 22 nt, Artificial Sequence
  Guide Sequence
uggggucgcgcaggauccucac

SEQ ID NO: 16054 - RNA, 22 nt, Artificial Sequence
  Guide Sequence
uggggugggguccgugcucuug

SEQ ID NO: 16055 - RNA, 22 nt, Artificial Sequence
  Guide Sequence
uguacucugggcacagcauagu

SEQ ID NO: 16056 - RNA, 22 nt, Artificial Sequence
  Guide Sequence
ugucgccuuggccugcccaucu

SEQ ID NO: 16057 - RNA, 22 nt, Artificial Sequence
  Guide Sequence
uguggagaugacugaaucgugc

SEQ ID NO: 16058 - RNA, 22 nt, Artificial Sequence
  Guide Sequence
uguguuccgguuccagccucuc

SEQ ID NO: 16059 - RNA, 22 nt, Artificial Sequence
  Guide Sequence
uguguugaggggagggcauuug

SEQ ID NO: 16060 - RNA, 22 nt, Artificial Sequence
  Guide Sequence
uguuagugcgauccagagaggc

SEQ ID NO: 16061 - RNA, 22 nt, Artificial Sequence
  Guide Sequence
uguucacaugcuugacuuucuc

SEQ ID NO: 16062 - RNA, 22 nt, Artificial Sequence
  Guide Sequence
uguuccgguuccagccucucuu

SEQ ID NO: 16063 - RNA, 22 nt, Artificial Sequence
  Guide Sequence
uguugaggggagggcauuuggg

SEQ ID NO: 16064 - RNA, 22 nt, Artificial Sequence
  Guide Sequence
uguuuggggccuccguggcucc

SEQ ID NO: 16065 - RNA, 22 nt, Artificial Sequence
  Guide Sequence
uuaggaugcgcuggagcgaaag

SEQ ID NO: 16066 - RNA, 22 nt, Artificial Sequence
  Guide Sequence
uuagugcgauccagagaggccg

SEQ ID NO: 16067 - RNA, 22 nt, Artificial Sequence
  Guide Sequence
uucaaaacggguggaggcuguc

SEQ ID NO: 16068 - RNA, 22 nt, Artificial Sequence
  Guide Sequence
uucagacccgcaggagccggag

SEQ ID NO: 16069 - RNA, 22 nt, Artificial Sequence
  Guide Sequence
uucagcgugaggccuggcuugu

SEQ ID NO: 16070 - RNA, 22 nt, Artificial Sequence
  Guide Sequence
uuccagccucucuuuguacucu

SEQ ID NO: 16071 - RNA, 22 nt, Artificial Sequence
  Guide Sequence
uuccgguuccagccucucuuug

SEQ ID NO: 16072 - RNA, 22 nt, Artificial Sequence
  Guide Sequence
uugaaggggccgugggaaguaa

SEQ ID NO: 16073 - RNA, 22 nt, Artificial Sequence
  Guide Sequence
uugaggggagggcauuugggau

SEQ ID NO: 16074 - RNA, 22 nt, Artificial Sequence
  Guide Sequence
uuggcagucgucucugccaggc

SEQ ID NO: 16075 - RNA, 22 nt, Artificial Sequence
  Guide Sequence
uuggccugcccaucugagcccc

SEQ ID NO: 16076 - RNA, 22 nt, Artificial Sequence
  Guide Sequence
uugggauaugggguaguuugug

SEQ ID NO: 16077 - RNA, 22 nt, Artificial Sequence
  Guide Sequence
uuggggacugagguucaaaacg

SEQ ID NO: 16078 - RNA, 22 nt, Artificial Sequence
  Guide Sequence
uuggggccuccguggcuccuuu

SEQ ID NO: 16079 - RNA, 22 nt, Artificial Sequence
  Guide Sequence
uuggggugggguccgugcucuu

SEQ ID NO: 16080 - RNA, 22 nt, Artificial Sequence
  Guide Sequence
uuguacucugggcacagcauag

SEQ ID NO: 16081 - RNA, 22 nt, Artificial Sequence
  Guide Sequence
uuguggagaugacugaaucgug

SEQ ID NO: 16082 - RNA, 22 nt, Artificial Sequence
  Guide Sequence
uuguguuccgguuccagccucu

SEQ ID NO: 16083 - RNA, 22 nt, Artificial Sequence
  Guide Sequence
uuguguugaggggagggcauuu

SEQ ID NO: 16084 - RNA, 22 nt, Artificial Sequence
  Guide Sequence
uuguuuggggccuccguggcuc

SEQ ID NO: 16085 - RNA, 22 nt, Artificial Sequence
  Guide Sequence
uuuaggaugcgcuggagcgaaa

SEQ ID NO: 16086 - RNA, 22 nt, Artificial Sequence
  Guide Sequence
uuucagcgugaggccuggcuug

SEQ ID NO: 16087 - RNA, 22 nt, Artificial Sequence
  Guide Sequence
uuugggauaugggguaguuugu

SEQ ID NO: 16088 - RNA, 22 nt, Artificial Sequence
  Guide Sequence
uuuggggacugagguucaaaac

SEQ ID NO: 16089 - RNA, 22 nt, Artificial Sequence
  Guide Sequence
uuuggggccuccguggcuccuu

SEQ ID NO: 16090 - RNA, 22 nt, Artificial Sequence
  Guide Sequence
uuuguacucugggcacagcaua

SEQ ID NO: 16091 - RNA, 22 nt, Artificial Sequence
  Guide Sequence
uuuguggagaugacugaaucgu

SEQ ID NO: 16092 - RNA, 20 nt, Artificial Sequence
  Guide Sequence
aaaccauacuucccugucuc

SEQ ID NO: 16093 - RNA, 20 nt, Artificial Sequence
  Guide Sequence
aaacccuugguugugucacc

SEQ ID NO: 16094 - RNA, 20 nt, Artificial Sequence
  Guide Sequence
aaccauacuucccugucucc

SEQ ID NO: 16095 - RNA, 20 nt, Artificial Sequence
  Guide Sequence
aacccuugguugugucacca

SEQ ID NO: 16096 - RNA, 20 nt, Artificial Sequence
  Guide Sequence
aacuuaggucuuuggcugga

SEQ ID NO: 16097 - RNA, 20 nt, Artificial Sequence
  Guide Sequence
aacuugguacuccaaguuuu

SEQ ID NO: 16098 - RNA, 20 nt, Artificial Sequence
  Guide Sequence
aagagcuuugugagaggagg

SEQ ID NO: 16099 - RNA, 20 nt, Artificial Sequence
  Guide Sequence
aagagggagagaaacccuug

SEQ ID NO: 16100 - RNA, 20 nt, Artificial Sequence
  Guide Sequence
aaucgugcuuuucccacugu

SEQ ID NO: 16101 - RNA, 20 nt, Artificial Sequence
  Guide Sequence
acaaaccauacuucccuguc

SEQ ID NO: 16102 - RNA, 20 nt, Artificial Sequence
  Guide Sequence
acauucgauaacuugguacu

SEQ ID NO: 16103 - RNA, 20 nt, Artificial Sequence
  Guide Sequence
acauucuaagagcuuuguga

SEQ ID NO: 16104 - RNA, 20 nt, Artificial Sequence
  Guide Sequence
accacuugcuuugugugaug

SEQ ID NO: 16105 - RNA, 20 nt, Artificial Sequence
  Guide Sequence
accauacuucccugucuccu

SEQ ID NO: 16106 - RNA, 20 nt, Artificial Sequence
  Guide Sequence
accccuggcacaaaccauac

SEQ ID NO: 16107 - RNA, 20 nt, Artificial Sequence
  Guide Sequence
acccuugguugugucaccac

SEQ ID NO: 16108 - RNA, 20 nt, Artificial Sequence
  Guide Sequence
accuguggcuuugagccuca

SEQ ID NO: 16109 - RNA, 20 nt, Artificial Sequence
  Guide Sequence
acuccaaguuuuuaugacau

SEQ ID NO: 16110 - RNA, 20 nt, Artificial Sequence
  Guide Sequence
acugaaucgugcuuuuccca

SEQ ID NO: 16111 - RNA, 20 nt, Artificial Sequence
  Guide Sequence
acuuaggucuuuggcuggag

SEQ ID NO: 16112 - RNA, 20 nt, Artificial Sequence
  Guide Sequence
acuucccugucuccucugag

SEQ ID NO: 16113 - RNA, 20 nt, Artificial Sequence
  Guide Sequence
acuugcuuugugugauguga

SEQ ID NO: 16114 - RNA, 20 nt, Artificial Sequence
  Guide Sequence
acuugguacuccaaguuuuu

SEQ ID NO: 16115 - RNA, 20 nt, Artificial Sequence
  Guide Sequence
agaaacccuugguuguguca

SEQ ID NO: 16116 - RNA, 20 nt, Artificial Sequence
  Guide Sequence
agagaaacccuugguugugu

SEQ ID NO: 16117 - RNA, 20 nt, Artificial Sequence
  Guide Sequence
agagcuuugugagaggagga

SEQ ID NO: 16118 - RNA, 20 nt, Artificial Sequence
  Guide Sequence
agaggaggaccuguggcuuu

SEQ ID NO: 16119 - RNA, 20 nt, Artificial Sequence
  Guide Sequence
agagggagagaaacccuugg

SEQ ID NO: 16120 - RNA, 20 nt, Artificial Sequence
  Guide Sequence
agaguggggagcugggugac

SEQ ID NO: 16121 - RNA, 20 nt, Artificial Sequence
  Guide Sequence
agaugacugaaucgugcuuu

SEQ ID NO: 16122 - RNA, 20 nt, Artificial Sequence
  Guide Sequence
agccucaggggaaaccagag

SEQ ID NO: 16123 - RNA, 20 nt, Artificial Sequence
  Guide Sequence
agcucuuucccgccccaaga

SEQ ID NO: 16124 - RNA, 20 nt, Artificial Sequence
  Guide Sequence
agcugggugaccccuggcac

SEQ ID NO: 16125 - RNA, 20 nt, Artificial Sequence
  Guide Sequence
agcuuugugagaggaggacc

SEQ ID NO: 16126 - RNA, 20 nt, Artificial Sequence
  Guide Sequence
aggaacuuaggucuuuggcu

SEQ ID NO: 16127 - RNA, 20 nt, Artificial Sequence
  Guide Sequence
aggaccuguggcuuugagcc

SEQ ID NO: 16128 - RNA, 20 nt, Artificial Sequence
  Guide Sequence
aggaggaccuguggcuuuga

SEQ ID NO: 16129 - RNA, 20 nt, Artificial Sequence
  Guide Sequence
agggagagaaacccuugguu

SEQ ID NO: 16130 - RNA, 20 nt, Artificial Sequence
  Guide Sequence
aggggaaaccagagacagau

SEQ ID NO: 16131 - RNA, 20 nt, Artificial Sequence
  Guide Sequence
aggucuuuggcuggagagug

SEQ ID NO: 16132 - RNA, 20 nt, Artificial Sequence
  Guide Sequence
aguggggagcugggugaccc

SEQ ID NO: 16133 - RNA, 20 nt, Artificial Sequence
  Guide Sequence
auaacuugguacuccaaguu

SEQ ID NO: 16134 - RNA, 20 nt, Artificial Sequence
  Guide Sequence
auacuucccugucuccucug

SEQ ID NO: 16135 - RNA, 20 nt, Artificial Sequence
  Guide Sequence
aucgugcuuuucccacuguu

SEQ ID NO: 16136 - RNA, 20 nt, Artificial Sequence
  Guide Sequence
augacauucuaagagcuuug

SEQ ID NO: 16137 - RNA, 20 nt, Artificial Sequence
  Guide Sequence
augacugaaucgugcuuuuc

SEQ ID NO: 16138 - RNA, 20 nt, Artificial Sequence
  Guide Sequence
augugacauucgauaacuug

SEQ ID NO: 16139 - RNA, 20 nt, Artificial Sequence
  Guide Sequence
auucgauaacuugguacucc

SEQ ID NO: 16140 - RNA, 20 nt, Artificial Sequence
  Guide Sequence
auucuaagagcuuugugaga

SEQ ID NO: 16141 - RNA, 20 nt, Artificial Sequence
  Guide Sequence
caaaccauacuucccugucu

SEQ ID NO: 16142 - RNA, 20 nt, Artificial Sequence
  Guide Sequence
caagagggagagaaacccuu

SEQ ID NO: 16143 - RNA, 20 nt, Artificial Sequence
  Guide Sequence
cacaaaccauacuucccugu

SEQ ID NO: 16144 - RNA, 20 nt, Artificial Sequence
  Guide Sequence
caccacuugcuuugugugau

SEQ ID NO: 16145 - RNA, 20 nt, Artificial Sequence
  Guide Sequence
cacuugcuuugugugaugug

SEQ ID NO: 16146 - RNA, 20 nt, Artificial Sequence
  Guide Sequence
caggggaaaccagagacaga

SEQ ID NO: 16147 - RNA, 20 nt, Artificial Sequence
  Guide Sequence
cauacuucccugucuccucu

SEQ ID NO: 16148 - RNA, 20 nt, Artificial Sequence
  Guide Sequence
cauucgauaacuugguacuc

SEQ ID NO: 16149 - RNA, 20 nt, Artificial Sequence
  Guide Sequence
cauucuaagagcuuugugag

SEQ ID NO: 16150 - RNA, 20 nt, Artificial Sequence
  Guide Sequence
ccaagagggagagaaacccu

SEQ ID NO: 16151 - RNA, 20 nt, Artificial Sequence
  Guide Sequence
ccaaguuuuuaugacauucu

SEQ ID NO: 16152 - RNA, 20 nt, Artificial Sequence
  Guide Sequence
ccacuugcuuugugugaugu

SEQ ID NO: 16153 - RNA, 20 nt, Artificial Sequence
  Guide Sequence
ccauacuucccugucuccuc

SEQ ID NO: 16154 - RNA, 20 nt, Artificial Sequence
  Guide Sequence
cccaagagggagagaaaccc

SEQ ID NO: 16155 - RNA, 20 nt, Artificial Sequence
  Guide Sequence
ccccaagagggagagaaacc

SEQ ID NO: 16156 - RNA, 20 nt, Artificial Sequence
  Guide Sequence
ccccuggcacaaaccauacu

SEQ ID NO: 16157 - RNA, 20 nt, Artificial Sequence
  Guide Sequence
cccgccccaagagggagaga

SEQ ID NO: 16158 - RNA, 20 nt, Artificial Sequence
  Guide Sequence
cccuggcacaaaccauacuu

SEQ ID NO: 16159 - RNA, 20 nt, Artificial Sequence
  Guide Sequence
cccugucuccucugagcucu

SEQ ID NO: 16160 - RNA, 20 nt, Artificial Sequence
  Guide Sequence
cccuugguugugucaccacu

SEQ ID NO: 16161 - RNA, 20 nt, Artificial Sequence
  Guide Sequence
ccgccccaagagggagagaa

SEQ ID NO: 16162 - RNA, 20 nt, Artificial Sequence
  Guide Sequence
ccucaggggaaaccagagac

SEQ ID NO: 16163 - RNA, 20 nt, Artificial Sequence
  Guide Sequence
ccucugagcucuuucccgcc

SEQ ID NO: 16164 - RNA, 20 nt, Artificial Sequence
  Guide Sequence
ccuggcacaaaccauacuuc

SEQ ID NO: 16165 - RNA, 20 nt, Artificial Sequence
  Guide Sequence
ccugucuccucugagcucuu

SEQ ID NO: 16166 - RNA, 20 nt, Artificial Sequence
  Guide Sequence
ccuguggcuuugagccucag

SEQ ID NO: 16167 - RNA, 20 nt, Artificial Sequence
  Guide Sequence
ccuugguugugucaccacuu

SEQ ID NO: 16168 - RNA, 20 nt, Artificial Sequence
  Guide Sequence
cgauaacuugguacuccaag

SEQ ID NO: 16169 - RNA, 20 nt, Artificial Sequence
  Guide Sequence
cgccccaagagggagagaaa

SEQ ID NO: 16170 - RNA, 20 nt, Artificial Sequence
  Guide Sequence
cgugcuuuucccacuguuuu

SEQ ID NO: 16171 - RNA, 20 nt, Artificial Sequence
  Guide Sequence
cuaagagcuuugugagagga

SEQ ID NO: 16172 - RNA, 20 nt, Artificial Sequence
  Guide Sequence
cucaggggaaaccagagaca

SEQ ID NO: 16173 - RNA, 20 nt, Artificial Sequence
  Guide Sequence
cuccaaguuuuuaugacauu

SEQ ID NO: 16174 - RNA, 20 nt, Artificial Sequence
  Guide Sequence
cuccucugagcucuuucccg

SEQ ID NO: 16175 - RNA, 20 nt, Artificial Sequence
  Guide Sequence
cucugagcucuuucccgccc

SEQ ID NO: 16176 - RNA, 20 nt, Artificial Sequence
  Guide Sequence
cucuuucccgccccaagagg

SEQ ID NO: 16177 - RNA, 20 nt, Artificial Sequence
  Guide Sequence
cugaaucgugcuuuucccac

SEQ ID NO: 16178 - RNA, 20 nt, Artificial Sequence
  Guide Sequence
cugagcucuuucccgcccca

SEQ ID NO: 16179 - RNA, 20 nt, Artificial Sequence
  Guide Sequence
cuggagaguggggagcuggg

SEQ ID NO: 16180 - RNA, 20 nt, Artificial Sequence
  Guide Sequence
cuggcacaaaccauacuucc

SEQ ID NO: 16181 - RNA, 20 nt, Artificial Sequence
  Guide Sequence
cugggugaccccuggcacaa

SEQ ID NO: 16182 - RNA, 20 nt, Artificial Sequence
  Guide Sequence
cugucuccucugagcucuuu

SEQ ID NO: 16183 - RNA, 20 nt, Artificial Sequence
  Guide Sequence
cuguggcuuugagccucagg

SEQ ID NO: 16184 - RNA, 20 nt, Artificial Sequence
  Guide Sequence
cuuaggucuuuggcuggaga

SEQ ID NO: 16185 - RNA, 20 nt, Artificial Sequence
  Guide Sequence
cuucccugucuccucugagc

SEQ ID NO: 16186 - RNA, 20 nt, Artificial Sequence
  Guide Sequence
cuugcuuugugugaugugac

SEQ ID NO: 16187 - RNA, 20 nt, Artificial Sequence
  Guide Sequence
cuugguacuccaaguuuuua

SEQ ID NO: 16188 - RNA, 20 nt, Artificial Sequence
  Guide Sequence
cuugguugugucaccacuug

SEQ ID NO: 16189 - RNA, 20 nt, Artificial Sequence
  Guide Sequence
cuuucccgccccaagaggga

SEQ ID NO: 16190 - RNA, 20 nt, Artificial Sequence
  Guide Sequence
cuuugagccucaggggaaac

SEQ ID NO: 16191 - RNA, 20 nt, Artificial Sequence
  Guide Sequence
cuuuggcuggagagugggga

SEQ ID NO: 16192 - RNA, 20 nt, Artificial Sequence
  Guide Sequence
cuuugugagaggaggaccug

SEQ ID NO: 16193 - RNA, 20 nt, Artificial Sequence
  Guide Sequence
cuuugugugaugugacauuc

SEQ ID NO: 16194 - RNA, 20 nt, Artificial Sequence
  Guide Sequence
gaaacccuugguugugucac

SEQ ID NO: 16195 - RNA, 20 nt, Artificial Sequence
  Guide Sequence
gaacuuaggucuuuggcugg

SEQ ID NO: 16196 - RNA, 20 nt, Artificial Sequence
  Guide Sequence
gaaucgugcuuuucccacug

SEQ ID NO: 16197 - RNA, 20 nt, Artificial Sequence
  Guide Sequence
gacauucgauaacuugguac

SEQ ID NO: 16198 - RNA, 20 nt, Artificial Sequence
  Guide Sequence
gacauucuaagagcuuugug

SEQ ID NO: 16199 - RNA, 20 nt, Artificial Sequence
  Guide Sequence
gaccccuggcacaaaccaua

SEQ ID NO: 16200 - RNA, 20 nt, Artificial Sequence
  Guide Sequence
gaccuguggcuuugagccuc

SEQ ID NO: 16201 - RNA, 20 nt, Artificial Sequence
  Guide Sequence
gacugaaucgugcuuuuccc

SEQ ID NO: 16202 - RNA, 20 nt, Artificial Sequence
  Guide Sequence
gagaaacccuugguuguguc

SEQ ID NO: 16203 - RNA, 20 nt, Artificial Sequence
  Guide Sequence
gagagaaacccuugguugug

SEQ ID NO: 16204 - RNA, 20 nt, Artificial Sequence
  Guide Sequence
gagaggaggaccuguggcuu

SEQ ID NO: 16205 - RNA, 20 nt, Artificial Sequence
  Guide Sequence
gagaguggggagcuggguga

SEQ ID NO: 16206 - RNA, 20 nt, Artificial Sequence
  Guide Sequence
gagccucaggggaaaccaga

SEQ ID NO: 16207 - RNA, 20 nt, Artificial Sequence
  Guide Sequence
gagcucuuucccgccccaag

SEQ ID NO: 16208 - RNA, 20 nt, Artificial Sequence
  Guide Sequence
gagcugggugaccccuggca

SEQ ID NO: 16209 - RNA, 20 nt, Artificial Sequence
  Guide Sequence
gagcuuugugagaggaggac

SEQ ID NO: 16210 - RNA, 20 nt, Artificial Sequence
  Guide Sequence
gaggaacuuaggucuuuggc

SEQ ID NO: 16211 - RNA, 20 nt, Artificial Sequence
  Guide Sequence
gaggaccuguggcuuugagc

SEQ ID NO: 16212 - RNA, 20 nt, Artificial Sequence
  Guide Sequence
gaggaggaccuguggcuuug

SEQ ID NO: 16213 - RNA, 20 nt, Artificial Sequence
  Guide Sequence
gagggagagaaacccuuggu

SEQ ID NO: 16214 - RNA, 20 nt, Artificial Sequence
  Guide Sequence
gaguggggagcugggugacc

SEQ ID NO: 16215 - RNA, 20 nt, Artificial Sequence
  Guide Sequence
gauaacuugguacuccaagu

SEQ ID NO: 16216 - RNA, 20 nt, Artificial Sequence
  Guide Sequence
gaugacugaaucgugcuuuu

SEQ ID NO: 16217 - RNA, 20 nt, Artificial Sequence
  Guide Sequence
gaugugacauucgauaacuu

SEQ ID NO: 16218 - RNA, 20 nt, Artificial Sequence
  Guide Sequence
gcacaaaccauacuucccug

SEQ ID NO: 16219 - RNA, 20 nt, Artificial Sequence
  Guide Sequence
gccccaagagggagagaaac

SEQ ID NO: 16220 - RNA, 20 nt, Artificial Sequence
  Guide Sequence
gccucaggggaaaccagaga

SEQ ID NO: 16221 - RNA, 20 nt, Artificial Sequence
  Guide Sequence
gcucuuucccgccccaagag

SEQ ID NO: 16222 - RNA, 20 nt, Artificial Sequence
  Guide Sequence
gcuggagaguggggagcugg

SEQ ID NO: 16223 - RNA, 20 nt, Artificial Sequence
  Guide Sequence
gcugggugaccccuggcaca

SEQ ID NO: 16224 - RNA, 20 nt, Artificial Sequence
  Guide Sequence
gcuuugagccucaggggaaa

SEQ ID NO: 16225 - RNA, 20 nt, Artificial Sequence
  Guide Sequence
gcuuugugagaggaggaccu

SEQ ID NO: 16226 - RNA, 20 nt, Artificial Sequence
  Guide Sequence
gcuuugugugaugugacauu

SEQ ID NO: 16227 - RNA, 20 nt, Artificial Sequence
  Guide Sequence
gcuuuucccacuguuuuggu

SEQ ID NO: 16228 - RNA, 20 nt, Artificial Sequence
  Guide Sequence
ggaacuuaggucuuuggcug

SEQ ID NO: 16229 - RNA, 20 nt, Artificial Sequence
  Guide Sequence
ggaccuguggcuuugagccu

SEQ ID NO: 16230 - RNA, 20 nt, Artificial Sequence
  Guide Sequence
ggagagaaacccuugguugu

SEQ ID NO: 16231 - RNA, 20 nt, Artificial Sequence
  Guide Sequence
ggagaguggggagcugggug

SEQ ID NO: 16232 - RNA, 20 nt, Artificial Sequence
  Guide Sequence
ggagcugggugaccccuggc

SEQ ID NO: 16233 - RNA, 20 nt, Artificial Sequence
  Guide Sequence
ggaggaccuguggcuuugag

SEQ ID NO: 16234 - RNA, 20 nt, Artificial Sequence
  Guide Sequence
ggcacaaaccauacuucccu

SEQ ID NO: 16235 - RNA, 20 nt, Artificial Sequence
  Guide Sequence
ggcuggagaguggggagcug

SEQ ID NO: 16236 - RNA, 20 nt, Artificial Sequence
  Guide Sequence
ggcuuugagccucaggggaa

SEQ ID NO: 16237 - RNA, 20 nt, Artificial Sequence
  Guide Sequence
gggagagaaacccuugguug

SEQ ID NO: 16238 - RNA, 20 nt, Artificial Sequence
  Guide Sequence
gggagcugggugaccccugg

SEQ ID NO: 16239 - RNA, 20 nt, Artificial Sequence
  Guide Sequence
ggggaaaccagagacagaug

SEQ ID NO: 16240 - RNA, 20 nt, Artificial Sequence
  Guide Sequence
ggggagcugggugaccccug

SEQ ID NO: 16241 - RNA, 20 nt, Artificial Sequence
  Guide Sequence
gggugaccccuggcacaaac

SEQ ID NO: 16242 - RNA, 20 nt, Artificial Sequence
  Guide Sequence
gguacuccaaguuuuuauga

SEQ ID NO: 16243 - RNA, 20 nt, Artificial Sequence
  Guide Sequence
ggucuuuggcuggagagugg

SEQ ID NO: 16244 - RNA, 20 nt, Artificial Sequence
  Guide Sequence
ggugaccccuggcacaaacc

SEQ ID NO: 16245 - RNA, 20 nt, Artificial Sequence
  Guide Sequence
ggugaggaacuuaggucuuu

SEQ ID NO: 16246 - RNA, 20 nt, Artificial Sequence
  Guide Sequence
gguugugucaccacuugcuu

SEQ ID NO: 16247 - RNA, 20 nt, Artificial Sequence
  Guide Sequence
guacuccaaguuuuuaugac

SEQ ID NO: 16248 - RNA, 20 nt, Artificial Sequence
  Guide Sequence
gucaccacuugcuuugugug

SEQ ID NO: 16249 - RNA, 20 nt, Artificial Sequence
  Guide Sequence
gucuccucugagcucuuucc

SEQ ID NO: 16250 - RNA, 20 nt, Artificial Sequence
  Guide Sequence
gucuuuggcuggagaguggg

SEQ ID NO: 16251 - RNA, 20 nt, Artificial Sequence
  Guide Sequence
gugacauucgauaacuuggu

SEQ ID NO: 16252 - RNA, 20 nt, Artificial Sequence
  Guide Sequence
gugaccccuggcacaaacca

SEQ ID NO: 16253 - RNA, 20 nt, Artificial Sequence
  Guide Sequence
gugagaggaggaccuguggc

SEQ ID NO: 16254 - RNA, 20 nt, Artificial Sequence
  Guide Sequence
gugaggaacuuaggucuuug

SEQ ID NO: 16255 - RNA, 20 nt, Artificial Sequence
  Guide Sequence
gugaugugacauucgauaac

SEQ ID NO: 16256 - RNA, 20 nt, Artificial Sequence
  Guide Sequence
gugcuuuucccacuguuuug

SEQ ID NO: 16257 - RNA, 20 nt, Artificial Sequence
  Guide Sequence
guggcuuugagccucagggg

SEQ ID NO: 16258 - RNA, 20 nt, Artificial Sequence
  Guide Sequence
guggggagcugggugacccc

SEQ ID NO: 16259 - RNA, 20 nt, Artificial Sequence
  Guide Sequence
gugucaccacuugcuuugug

SEQ ID NO: 16260 - RNA, 20 nt, Artificial Sequence
  Guide Sequence
gugugaugugacauucgaua

SEQ ID NO: 16261 - RNA, 20 nt, Artificial Sequence
  Guide Sequence
guugugucaccacuugcuuu

SEQ ID NO: 16262 - RNA, 20 nt, Artificial Sequence
  Guide Sequence
uaacuugguacuccaaguuu

SEQ ID NO: 16263 - RNA, 20 nt, Artificial Sequence
  Guide Sequence
uaagagcuuugugagaggag

SEQ ID NO: 16264 - RNA, 20 nt, Artificial Sequence
  Guide Sequence
uacuccaaguuuuuaugaca

SEQ ID NO: 16265 - RNA, 20 nt, Artificial Sequence
  Guide Sequence
uacuucccugucuccucuga

SEQ ID NO: 16266 - RNA, 20 nt, Artificial Sequence
  Guide Sequence
uaggucuuuggcuggagagu

SEQ ID NO: 16267 - RNA, 20 nt, Artificial Sequence
  Guide Sequence
uaugacauucuaagagcuuu

SEQ ID NO: 16268 - RNA, 20 nt, Artificial Sequence
  Guide Sequence
ucaccacuugcuuuguguga

SEQ ID NO: 16269 - RNA, 20 nt, Artificial Sequence
  Guide Sequence
ucaggggaaaccagagacag

SEQ ID NO: 16270 - RNA, 20 nt, Artificial Sequence
  Guide Sequence
uccaaguuuuuaugacauuc

SEQ ID NO: 16271 - RNA, 20 nt, Artificial Sequence
  Guide Sequence
ucccgccccaagagggagag

SEQ ID NO: 16272 - RNA, 20 nt, Artificial Sequence
  Guide Sequence
ucccugucuccucugagcuc

SEQ ID NO: 16273 - RNA, 20 nt, Artificial Sequence
  Guide Sequence
uccucugagcucuuucccgc

SEQ ID NO: 16274 - RNA, 20 nt, Artificial Sequence
  Guide Sequence
ucgauaacuugguacuccaa

SEQ ID NO: 16275 - RNA, 20 nt, Artificial Sequence
  Guide Sequence
ucgugcuuuucccacuguuu

SEQ ID NO: 16276 - RNA, 20 nt, Artificial Sequence
  Guide Sequence
ucuaagagcuuugugagagg

SEQ ID NO: 16277 - RNA, 20 nt, Artificial Sequence
  Guide Sequence
ucuccucugagcucuuuccc

SEQ ID NO: 16278 - RNA, 20 nt, Artificial Sequence
  Guide Sequence
ucugagcucuuucccgcccc

SEQ ID NO: 16279 - RNA, 20 nt, Artificial Sequence
  Guide Sequence
ucuuucccgccccaagaggg

SEQ ID NO: 16280 - RNA, 20 nt, Artificial Sequence
  Guide Sequence
ucuuuggcuggagagugggg

SEQ ID NO: 16281 - RNA, 20 nt, Artificial Sequence
  Guide Sequence
ugaaucgugcuuuucccacu

SEQ ID NO: 16282 - RNA, 20 nt, Artificial Sequence
  Guide Sequence
ugacauucgauaacuuggua

SEQ ID NO: 16283 - RNA, 20 nt, Artificial Sequence
  Guide Sequence
ugacauucuaagagcuuugu

SEQ ID NO: 16284 - RNA, 20 nt, Artificial Sequence
  Guide Sequence
ugaccccuggcacaaaccau

SEQ ID NO: 16285 - RNA, 20 nt, Artificial Sequence
  Guide Sequence
ugacugaaucgugcuuuucc

SEQ ID NO: 16286 - RNA, 20 nt, Artificial Sequence
  Guide Sequence
ugagaggaggaccuguggcu

SEQ ID NO: 16287 - RNA, 20 nt, Artificial Sequence
  Guide Sequence
ugagccucaggggaaaccag

SEQ ID NO: 16288 - RNA, 20 nt, Artificial Sequence
  Guide Sequence
ugagcucuuucccgccccaa

SEQ ID NO: 16289 - RNA, 20 nt, Artificial Sequence
  Guide Sequence
ugaggaacuuaggucuuugg

SEQ ID NO: 16290 - RNA, 20 nt, Artificial Sequence
  Guide Sequence
ugaugugacauucgauaacu

SEQ ID NO: 16291 - RNA, 20 nt, Artificial Sequence
  Guide Sequence
ugcuuugugugaugugacau

SEQ ID NO: 16292 - RNA, 20 nt, Artificial Sequence
  Guide Sequence
ugcuuuucccacuguuuugg

SEQ ID NO: 16293 - RNA, 20 nt, Artificial Sequence
  Guide Sequence
uggagaguggggagcugggu

SEQ ID NO: 16294 - RNA, 20 nt, Artificial Sequence
  Guide Sequence
uggcacaaaccauacuuccc

SEQ ID NO: 16295 - RNA, 20 nt, Artificial Sequence
  Guide Sequence
uggcuggagaguggggagcu

SEQ ID NO: 16296 - RNA, 20 nt, Artificial Sequence
  Guide Sequence
uggcuuugagccucagggga

SEQ ID NO: 16297 - RNA, 20 nt, Artificial Sequence
  Guide Sequence
uggggagcugggugaccccu

SEQ ID NO: 16298 - RNA, 20 nt, Artificial Sequence
  Guide Sequence
ugggugaccccuggcacaaa

SEQ ID NO: 16299 - RNA, 20 nt, Artificial Sequence
  Guide Sequence
ugguacuccaaguuuuuaug

SEQ ID NO: 16300 - RNA, 20 nt, Artificial Sequence
  Guide Sequence
ugguugugucaccacuugcu

SEQ ID NO: 16301 - RNA, 20 nt, Artificial Sequence
  Guide Sequence
ugucaccacuugcuuugugu

SEQ ID NO: 16302 - RNA, 20 nt, Artificial Sequence
  Guide Sequence
ugucuccucugagcucuuuc

SEQ ID NO: 16303 - RNA, 20 nt, Artificial Sequence
  Guide Sequence
ugugacauucgauaacuugg

SEQ ID NO: 16304 - RNA, 20 nt, Artificial Sequence
  Guide Sequence
ugugagaggaggaccugugg

SEQ ID NO: 16305 - RNA, 20 nt, Artificial Sequence
  Guide Sequence
ugugaugugacauucgauaa

SEQ ID NO: 16306 - RNA, 20 nt, Artificial Sequence
  Guide Sequence
uguggcuuugagccucaggg

SEQ ID NO: 16307 - RNA, 20 nt, Artificial Sequence
  Guide Sequence
ugugucaccacuugcuuugu

SEQ ID NO: 16308 - RNA, 20 nt, Artificial Sequence
  Guide Sequence
ugugugaugugacauucgau

SEQ ID NO: 16309 - RNA, 20 nt, Artificial Sequence
  Guide Sequence
uuaggucuuuggcuggagag

SEQ ID NO: 16310 - RNA, 20 nt, Artificial Sequence
  Guide Sequence
uuaugacauucuaagagcuu

SEQ ID NO: 16311 - RNA, 20 nt, Artificial Sequence
  Guide Sequence
uucccgccccaagagggaga

SEQ ID NO: 16312 - RNA, 20 nt, Artificial Sequence
  Guide Sequence
uucccugucuccucugagcu

SEQ ID NO: 16313 - RNA, 20 nt, Artificial Sequence
  Guide Sequence
uucgauaacuugguacucca

SEQ ID NO: 16314 - RNA, 20 nt, Artificial Sequence
  Guide Sequence
uucuaagagcuuugugagag

SEQ ID NO: 16315 - RNA, 20 nt, Artificial Sequence
  Guide Sequence
uugagccucaggggaaacca

SEQ ID NO: 16316 - RNA, 20 nt, Artificial Sequence
  Guide Sequence
uugcuuugugugaugugaca

SEQ ID NO: 16317 - RNA, 20 nt, Artificial Sequence
  Guide Sequence
uuggcuggagaguggggagc

SEQ ID NO: 16318 - RNA, 20 nt, Artificial Sequence
  Guide Sequence
uugguacuccaaguuuuuau

SEQ ID NO: 16319 - RNA, 20 nt, Artificial Sequence
  Guide Sequence
uugguugugucaccacuugc

SEQ ID NO: 16320 - RNA, 20 nt, Artificial Sequence
  Guide Sequence
uugugagaggaggaccugug

SEQ ID NO: 16321 - RNA, 20 nt, Artificial Sequence
  Guide Sequence
uugugucaccacuugcuuug

SEQ ID NO: 16322 - RNA, 20 nt, Artificial Sequence
  Guide Sequence
uugugugaugugacauucga

SEQ ID NO: 16323 - RNA, 20 nt, Artificial Sequence
  Guide Sequence
uuuaugacauucuaagagcu

SEQ ID NO: 16324 - RNA, 20 nt, Artificial Sequence
  Guide Sequence
uuucccgccccaagagggag

SEQ ID NO: 16325 - RNA, 20 nt, Artificial Sequence
  Guide Sequence
uuugagccucaggggaaacc

SEQ ID NO: 16326 - RNA, 20 nt, Artificial Sequence
  Guide Sequence
uuuggcuggagaguggggag

SEQ ID NO: 16327 - RNA, 20 nt, Artificial Sequence
  Guide Sequence
uuugugagaggaggaccugu

SEQ ID NO: 16328 - RNA, 20 nt, Artificial Sequence
  Guide Sequence
uuugugugaugugacauucg

SEQ ID NO: 16329 - RNA, 20 nt, Artificial Sequence
  Guide Sequence
uuuuaugacauucuaagagc

SEQ ID NO: 16330 - RNA, 21 nt, Artificial Sequence
  Guide Sequence
aaaccauacuucccugucucc

SEQ ID NO: 16331 - RNA, 21 nt, Artificial Sequence
  Guide Sequence
aaacccuugguugugucacca

SEQ ID NO: 16332 - RNA, 21 nt, Artificial Sequence
  Guide Sequence
aaccauacuucccugucuccu

SEQ ID NO: 16333 - RNA, 21 nt, Artificial Sequence
  Guide Sequence
aacccuugguugugucaccac

SEQ ID NO: 16334 - RNA, 21 nt, Artificial Sequence
  Guide Sequence
aacuuaggucuuuggcuggag

SEQ ID NO: 16335 - RNA, 21 nt, Artificial Sequence
  Guide Sequence
aacuugguacuccaaguuuuu

SEQ ID NO: 16336 - RNA, 21 nt, Artificial Sequence
  Guide Sequence
aagagcuuugugagaggagga

SEQ ID NO: 16337 - RNA, 21 nt, Artificial Sequence
  Guide Sequence
aagagggagagaaacccuugg

SEQ ID NO: 16338 - RNA, 21 nt, Artificial Sequence
  Guide Sequence
aaucgugcuuuucccacuguu

SEQ ID NO: 16339 - RNA, 21 nt, Artificial Sequence
  Guide Sequence
acaaaccauacuucccugucu

SEQ ID NO: 16340 - RNA, 21 nt, Artificial Sequence
  Guide Sequence
acauucgauaacuugguacuc

SEQ ID NO: 16341 - RNA, 21 nt, Artificial Sequence
  Guide Sequence
acauucuaagagcuuugugag

SEQ ID NO: 16342 - RNA, 21 nt, Artificial Sequence
  Guide Sequence
accacuugcuuugugugaugu

SEQ ID NO: 16343 - RNA, 21 nt, Artificial Sequence
  Guide Sequence
accauacuucccugucuccuc

SEQ ID NO: 16344 - RNA, 21 nt, Artificial Sequence
  Guide Sequence
accccuggcacaaaccauacu

SEQ ID NO: 16345 - RNA, 21 nt, Artificial Sequence
  Guide Sequence
acccuugguugugucaccacu

SEQ ID NO: 16346 - RNA, 21 nt, Artificial Sequence
  Guide Sequence
accuguggcuuugagccucag

SEQ ID NO: 16347 - RNA, 21 nt, Artificial Sequence
  Guide Sequence
acugaaucgugcuuuucccac

SEQ ID NO: 16348 - RNA, 21 nt, Artificial Sequence
  Guide Sequence
acuuaggucuuuggcuggaga

SEQ ID NO: 16349 - RNA, 21 nt, Artificial Sequence
  Guide Sequence
acuucccugucuccucugagc

SEQ ID NO: 16350 - RNA, 21 nt, Artificial Sequence
  Guide Sequence
acuugcuuugugugaugugac

SEQ ID NO: 16351 - RNA, 21 nt, Artificial Sequence
  Guide Sequence
acuugguacuccaaguuuuua

SEQ ID NO: 16352 - RNA, 21 nt, Artificial Sequence
  Guide Sequence
agaaacccuugguugugucac

SEQ ID NO: 16353 - RNA, 21 nt, Artificial Sequence
  Guide Sequence
agagaaacccuugguuguguc

SEQ ID NO: 16354 - RNA, 21 nt, Artificial Sequence
  Guide Sequence
agagcuuugugagaggaggac

SEQ ID NO: 16355 - RNA, 21 nt, Artificial Sequence
  Guide Sequence
agaggaggaccuguggcuuug

SEQ ID NO: 16356 - RNA, 21 nt, Artificial Sequence
  Guide Sequence
agagggagagaaacccuuggu

SEQ ID NO: 16357 - RNA, 21 nt, Artificial Sequence
  Guide Sequence
agaguggggagcugggugacc

SEQ ID NO: 16358 - RNA, 21 nt, Artificial Sequence
  Guide Sequence
agaugacugaaucgugcuuuu

SEQ ID NO: 16359 - RNA, 21 nt, Artificial Sequence
  Guide Sequence
agccucaggggaaaccagaga

SEQ ID NO: 16360 - RNA, 21 nt, Artificial Sequence
  Guide Sequence
agcucuuucccgccccaagag

SEQ ID NO: 16361 - RNA, 21 nt, Artificial Sequence
  Guide Sequence
agcugggugaccccuggcaca

SEQ ID NO: 16362 - RNA, 21 nt, Artificial Sequence
  Guide Sequence
agcuuugugagaggaggaccu

SEQ ID NO: 16363 - RNA, 21 nt, Artificial Sequence
  Guide Sequence
aggaacuuaggucuuuggcug

SEQ ID NO: 16364 - RNA, 21 nt, Artificial Sequence
  Guide Sequence
aggaccuguggcuuugagccu

SEQ ID NO: 16365 - RNA, 21 nt, Artificial Sequence
  Guide Sequence
aggaggaccuguggcuuugag

SEQ ID NO: 16366 - RNA, 21 nt, Artificial Sequence
  Guide Sequence
agggagagaaacccuugguug

SEQ ID NO: 16367 - RNA, 21 nt, Artificial Sequence
  Guide Sequence
aggggaaaccagagacagaug

SEQ ID NO: 16368 - RNA, 21 nt, Artificial Sequence
  Guide Sequence
aggucuuuggcuggagagugg

SEQ ID NO: 16369 - RNA, 21 nt, Artificial Sequence
  Guide Sequence
aguggggagcugggugacccc

SEQ ID NO: 16370 - RNA, 21 nt, Artificial Sequence
  Guide Sequence
auaacuugguacuccaaguuu

SEQ ID NO: 16371 - RNA, 21 nt, Artificial Sequence
  Guide Sequence
auacuucccugucuccucuga

SEQ ID NO: 16372 - RNA, 21 nt, Artificial Sequence
  Guide Sequence
aucgugcuuuucccacuguuu

SEQ ID NO: 16373 - RNA, 21 nt, Artificial Sequence
  Guide Sequence
augacauucuaagagcuuugu

SEQ ID NO: 16374 - RNA, 21 nt, Artificial Sequence
  Guide Sequence
augacugaaucgugcuuuucc

SEQ ID NO: 16375 - RNA, 21 nt, Artificial Sequence
  Guide Sequence
augugacauucgauaacuugg

SEQ ID NO: 16376 - RNA, 21 nt, Artificial Sequence
  Guide Sequence
auucgauaacuugguacucca

SEQ ID NO: 16377 - RNA, 21 nt, Artificial Sequence
  Guide Sequence
auucuaagagcuuugugagag

SEQ ID NO: 16378 - RNA, 21 nt, Artificial Sequence
  Guide Sequence
caaaccauacuucccugucuc

SEQ ID NO: 16379 - RNA, 21 nt, Artificial Sequence
  Guide Sequence
caagagggagagaaacccuug

SEQ ID NO: 16380 - RNA, 21 nt, Artificial Sequence
  Guide Sequence
cacaaaccauacuucccuguc

SEQ ID NO: 16381 - RNA, 21 nt, Artificial Sequence
  Guide Sequence
caccacuugcuuugugugaug

SEQ ID NO: 16382 - RNA, 21 nt, Artificial Sequence
  Guide Sequence
cacuugcuuugugugauguga

SEQ ID NO: 16383 - RNA, 21 nt, Artificial Sequence
  Guide Sequence
caggggaaaccagagacagau

SEQ ID NO: 16384 - RNA, 21 nt, Artificial Sequence
  Guide Sequence
cauacuucccugucuccucug

SEQ ID NO: 16385 - RNA, 21 nt, Artificial Sequence
  Guide Sequence
cauucgauaacuugguacucc

SEQ ID NO: 16386 - RNA, 21 nt, Artificial Sequence
  Guide Sequence
cauucuaagagcuuugugaga

SEQ ID NO: 16387 - RNA, 21 nt, Artificial Sequence
  Guide Sequence
ccaagagggagagaaacccuu

SEQ ID NO: 16388 - RNA, 21 nt, Artificial Sequence
  Guide Sequence
ccacuugcuuugugugaugug

SEQ ID NO: 16389 - RNA, 21 nt, Artificial Sequence
  Guide Sequence
ccauacuucccugucuccucu

SEQ ID NO: 16390 - RNA, 21 nt, Artificial Sequence
  Guide Sequence
cccaagagggagagaaacccu

SEQ ID NO: 16391 - RNA, 21 nt, Artificial Sequence
  Guide Sequence
ccccaagagggagagaaaccc

SEQ ID NO: 16392 - RNA, 21 nt, Artificial Sequence
  Guide Sequence
ccccuggcacaaaccauacuu

SEQ ID NO: 16393 - RNA, 21 nt, Artificial Sequence
  Guide Sequence
cccgccccaagagggagagaa

SEQ ID NO: 16394 - RNA, 21 nt, Artificial Sequence
  Guide Sequence
cccuggcacaaaccauacuuc

SEQ ID NO: 16395 - RNA, 21 nt, Artificial Sequence
  Guide Sequence
cccugucuccucugagcucuu

SEQ ID NO: 16396 - RNA, 21 nt, Artificial Sequence
  Guide Sequence
cccuugguugugucaccacuu

SEQ ID NO: 16397 - RNA, 21 nt, Artificial Sequence
  Guide Sequence
ccgccccaagagggagagaaa

SEQ ID NO: 16398 - RNA, 21 nt, Artificial Sequence
  Guide Sequence
ccucaggggaaaccagagaca

SEQ ID NO: 16399 - RNA, 21 nt, Artificial Sequence
  Guide Sequence
ccucugagcucuuucccgccc

SEQ ID NO: 16400 - RNA, 21 nt, Artificial Sequence
  Guide Sequence
ccuggcacaaaccauacuucc

SEQ ID NO: 16401 - RNA, 21 nt, Artificial Sequence
  Guide Sequence
ccugucuccucugagcucuuu

SEQ ID NO: 16402 - RNA, 21 nt, Artificial Sequence
  Guide Sequence
ccuguggcuuugagccucagg

SEQ ID NO: 16403 - RNA, 21 nt, Artificial Sequence
  Guide Sequence
ccuugguugugucaccacuug

SEQ ID NO: 16404 - RNA, 21 nt, Artificial Sequence
  Guide Sequence
cgauaacuugguacuccaagu

SEQ ID NO: 16405 - RNA, 21 nt, Artificial Sequence
  Guide Sequence
cgccccaagagggagagaaac

SEQ ID NO: 16406 - RNA, 21 nt, Artificial Sequence
  Guide Sequence
cgugcuuuucccacuguuuug

SEQ ID NO: 16407 - RNA, 21 nt, Artificial Sequence
  Guide Sequence
cuaagagcuuugugagaggag

SEQ ID NO: 16408 - RNA, 21 nt, Artificial Sequence
  Guide Sequence
cucaggggaaaccagagacag

SEQ ID NO: 16409 - RNA, 21 nt, Artificial Sequence
  Guide Sequence
cuccaaguuuuuaugacauuc

SEQ ID NO: 16410 - RNA, 21 nt, Artificial Sequence
  Guide Sequence
cuccucugagcucuuucccgc

SEQ ID NO: 16411 - RNA, 21 nt, Artificial Sequence
  Guide Sequence
cucugagcucuuucccgcccc

SEQ ID NO: 16412 - RNA, 21 nt, Artificial Sequence
  Guide Sequence
cucuuucccgccccaagaggg

SEQ ID NO: 16413 - RNA, 21 nt, Artificial Sequence
  Guide Sequence
cugaaucgugcuuuucccacu

SEQ ID NO: 16414 - RNA, 21 nt, Artificial Sequence
  Guide Sequence
cugagcucuuucccgccccaa

SEQ ID NO: 16415 - RNA, 21 nt, Artificial Sequence
  Guide Sequence
cuggagaguggggagcugggu

SEQ ID NO: 16416 - RNA, 21 nt, Artificial Sequence
  Guide Sequence
cuggcacaaaccauacuuccc

SEQ ID NO: 16417 - RNA, 21 nt, Artificial Sequence
  Guide Sequence
cugggugaccccuggcacaaa

SEQ ID NO: 16418 - RNA, 21 nt, Artificial Sequence
  Guide Sequence
cugucuccucugagcucuuuc

SEQ ID NO: 16419 - RNA, 21 nt, Artificial Sequence
  Guide Sequence
cuguggcuuugagccucaggg

SEQ ID NO: 16420 - RNA, 21 nt, Artificial Sequence
  Guide Sequence
cuuaggucuuuggcuggagag

SEQ ID NO: 16421 - RNA, 21 nt, Artificial Sequence
  Guide Sequence
cuucccugucuccucugagcu

SEQ ID NO: 16422 - RNA, 21 nt, Artificial Sequence
  Guide Sequence
cuugcuuugugugaugugaca

SEQ ID NO: 16423 - RNA, 21 nt, Artificial Sequence
  Guide Sequence
cuugguacuccaaguuuuuau

SEQ ID NO: 16424 - RNA, 21 nt, Artificial Sequence
  Guide Sequence
cuugguugugucaccacuugc

SEQ ID NO: 16425 - RNA, 21 nt, Artificial Sequence
  Guide Sequence
cuuucccgccccaagagggag

SEQ ID NO: 16426 - RNA, 21 nt, Artificial Sequence
  Guide Sequence
cuuugagccucaggggaaacc

SEQ ID NO: 16427 - RNA, 21 nt, Artificial Sequence
  Guide Sequence
cuuuggcuggagaguggggag

SEQ ID NO: 16428 - RNA, 21 nt, Artificial Sequence
  Guide Sequence
cuuugugagaggaggaccugu

SEQ ID NO: 16429 - RNA, 21 nt, Artificial Sequence
  Guide Sequence
cuuugugugaugugacauucg

SEQ ID NO: 16430 - RNA, 21 nt, Artificial Sequence
  Guide Sequence
gaaacccuugguugugucacc

SEQ ID NO: 16431 - RNA, 21 nt, Artificial Sequence
  Guide Sequence
gaacuuaggucuuuggcugga

SEQ ID NO: 16432 - RNA, 21 nt, Artificial Sequence
  Guide Sequence
gaaucgugcuuuucccacugu

SEQ ID NO: 16433 - RNA, 21 nt, Artificial Sequence
  Guide Sequence
gacauucgauaacuugguacu

SEQ ID NO: 16434 - RNA, 21 nt, Artificial Sequence
  Guide Sequence
gacauucuaagagcuuuguga

SEQ ID NO: 16435 - RNA, 21 nt, Artificial Sequence
  Guide Sequence
gaccccuggcacaaaccauac

SEQ ID NO: 16436 - RNA, 21 nt, Artificial Sequence
  Guide Sequence
gaccuguggcuuugagccuca

SEQ ID NO: 16437 - RNA, 21 nt, Artificial Sequence
  Guide Sequence
gacugaaucgugcuuuuccca

SEQ ID NO: 16438 - RNA, 21 nt, Artificial Sequence
  Guide Sequence
gagaaacccuugguuguguca

SEQ ID NO: 16439 - RNA, 21 nt, Artificial Sequence
  Guide Sequence
gagagaaacccuugguugugu

SEQ ID NO: 16440 - RNA, 21 nt, Artificial Sequence
  Guide Sequence
gagaggaggaccuguggcuuu

SEQ ID NO: 16441 - RNA, 21 nt, Artificial Sequence
  Guide Sequence
gagaguggggagcugggugac

SEQ ID NO: 16442 - RNA, 21 nt, Artificial Sequence
  Guide Sequence
gagaugacugaaucgugcuuu

SEQ ID NO: 16443 - RNA, 21 nt, Artificial Sequence
  Guide Sequence
gagccucaggggaaaccagag

SEQ ID NO: 16444 - RNA, 21 nt, Artificial Sequence
  Guide Sequence
gagcucuuucccgccccaaga

SEQ ID NO: 16445 - RNA, 21 nt, Artificial Sequence
  Guide Sequence
gagcugggugaccccuggcac

SEQ ID NO: 16446 - RNA, 21 nt, Artificial Sequence
  Guide Sequence
gagcuuugugagaggaggacc

SEQ ID NO: 16447 - RNA, 21 nt, Artificial Sequence
  Guide Sequence
gaggaacuuaggucuuuggcu

SEQ ID NO: 16448 - RNA, 21 nt, Artificial Sequence
  Guide Sequence
gaggaccuguggcuuugagcc

SEQ ID NO: 16449 - RNA, 21 nt, Artificial Sequence
  Guide Sequence
gaggaggaccuguggcuuuga

SEQ ID NO: 16450 - RNA, 21 nt, Artificial Sequence
  Guide Sequence
gagggagagaaacccuugguu

SEQ ID NO: 16451 - RNA, 21 nt, Artificial Sequence
  Guide Sequence
gaguggggagcugggugaccc

SEQ ID NO: 16452 - RNA, 21 nt, Artificial Sequence
  Guide Sequence
gauaacuugguacuccaaguu

SEQ ID NO: 16453 - RNA, 21 nt, Artificial Sequence
  Guide Sequence
gaugacugaaucgugcuuuuc

SEQ ID NO: 16454 - RNA, 21 nt, Artificial Sequence
  Guide Sequence
gaugugacauucgauaacuug

SEQ ID NO: 16455 - RNA, 21 nt, Artificial Sequence
  Guide Sequence
gcacaaaccauacuucccugu

SEQ ID NO: 16456 - RNA, 21 nt, Artificial Sequence
  Guide Sequence
gccccaagagggagagaaacc

SEQ ID NO: 16457 - RNA, 21 nt, Artificial Sequence
  Guide Sequence
gccucaggggaaaccagagac

SEQ ID NO: 16458 - RNA, 21 nt, Artificial Sequence
  Guide Sequence
gcucuuucccgccccaagagg

SEQ ID NO: 16459 - RNA, 21 nt, Artificial Sequence
  Guide Sequence
gcuggagaguggggagcuggg

SEQ ID NO: 16460 - RNA, 21 nt, Artificial Sequence
  Guide Sequence
gcugggugaccccuggcacaa

SEQ ID NO: 16461 - RNA, 21 nt, Artificial Sequence
  Guide Sequence
gcuuugagccucaggggaaac

SEQ ID NO: 16462 - RNA, 21 nt, Artificial Sequence
  Guide Sequence
gcuuugugagaggaggaccug

SEQ ID NO: 16463 - RNA, 21 nt, Artificial Sequence
  Guide Sequence
gcuuugugugaugugacauuc

SEQ ID NO: 16464 - RNA, 21 nt, Artificial Sequence
  Guide Sequence
ggaacuuaggucuuuggcugg

SEQ ID NO: 16465 - RNA, 21 nt, Artificial Sequence
  Guide Sequence
ggaccuguggcuuugagccuc

SEQ ID NO: 16466 - RNA, 21 nt, Artificial Sequence
  Guide Sequence
ggagagaaacccuugguugug

SEQ ID NO: 16467 - RNA, 21 nt, Artificial Sequence
  Guide Sequence
ggagaguggggagcuggguga

SEQ ID NO: 16468 - RNA, 21 nt, Artificial Sequence
  Guide Sequence
ggagcugggugaccccuggca

SEQ ID NO: 16469 - RNA, 21 nt, Artificial Sequence
  Guide Sequence
ggaggaccuguggcuuugagc

SEQ ID NO: 16470 - RNA, 21 nt, Artificial Sequence
  Guide Sequence
ggcacaaaccauacuucccug

SEQ ID NO: 16471 - RNA, 21 nt, Artificial Sequence
  Guide Sequence
ggcuggagaguggggagcugg

SEQ ID NO: 16472 - RNA, 21 nt, Artificial Sequence
  Guide Sequence
ggcuuugagccucaggggaaa

SEQ ID NO: 16473 - RNA, 21 nt, Artificial Sequence
  Guide Sequence
gggagagaaacccuugguugu

SEQ ID NO: 16474 - RNA, 21 nt, Artificial Sequence
  Guide Sequence
gggagcugggugaccccuggc

SEQ ID NO: 16475 - RNA, 21 nt, Artificial Sequence
  Guide Sequence
ggggagcugggugaccccugg

SEQ ID NO: 16476 - RNA, 21 nt, Artificial Sequence
  Guide Sequence
gggugaccccuggcacaaacc

SEQ ID NO: 16477 - RNA, 21 nt, Artificial Sequence
  Guide Sequence
gguacuccaaguuuuuaugac

SEQ ID NO: 16478 - RNA, 21 nt, Artificial Sequence
  Guide Sequence
ggucuuuggcuggagaguggg

SEQ ID NO: 16479 - RNA, 21 nt, Artificial Sequence
  Guide Sequence
ggugaccccuggcacaaacca

SEQ ID NO: 16480 - RNA, 21 nt, Artificial Sequence
  Guide Sequence
ggugaggaacuuaggucuuug

SEQ ID NO: 16481 - RNA, 21 nt, Artificial Sequence
  Guide Sequence
gguugugucaccacuugcuuu

SEQ ID NO: 16482 - RNA, 21 nt, Artificial Sequence
  Guide Sequence
guacuccaaguuuuuaugaca

SEQ ID NO: 16483 - RNA, 21 nt, Artificial Sequence
  Guide Sequence
gucaccacuugcuuuguguga

SEQ ID NO: 16484 - RNA, 21 nt, Artificial Sequence
  Guide Sequence
gucuccucugagcucuuuccc

SEQ ID NO: 16485 - RNA, 21 nt, Artificial Sequence
  Guide Sequence
gucuuuggcuggagagugggg

SEQ ID NO: 16486 - RNA, 21 nt, Artificial Sequence
  Guide Sequence
gugacauucgauaacuuggua

SEQ ID NO: 16487 - RNA, 21 nt, Artificial Sequence
  Guide Sequence
gugaccccuggcacaaaccau

SEQ ID NO: 16488 - RNA, 21 nt, Artificial Sequence
  Guide Sequence
gugagaggaggaccuguggcu

SEQ ID NO: 16489 - RNA, 21 nt, Artificial Sequence
  Guide Sequence
gugaggaacuuaggucuuugg

SEQ ID NO: 16490 - RNA, 21 nt, Artificial Sequence
  Guide Sequence
gugaugugacauucgauaacu

SEQ ID NO: 16491 - RNA, 21 nt, Artificial Sequence
  Guide Sequence
gugcuuuucccacuguuuugg

SEQ ID NO: 16492 - RNA, 21 nt, Artificial Sequence
  Guide Sequence
guggcuuugagccucagggga

SEQ ID NO: 16493 - RNA, 21 nt, Artificial Sequence
  Guide Sequence
guggggagcugggugaccccu

SEQ ID NO: 16494 - RNA, 21 nt, Artificial Sequence
  Guide Sequence
gugucaccacuugcuuugugu

SEQ ID NO: 16495 - RNA, 21 nt, Artificial Sequence
  Guide Sequence
gugugaugugacauucgauaa

SEQ ID NO: 16496 - RNA, 21 nt, Artificial Sequence
  Guide Sequence
guugugucaccacuugcuuug

SEQ ID NO: 16497 - RNA, 21 nt, Artificial Sequence
  Guide Sequence
uaacuugguacuccaaguuuu

SEQ ID NO: 16498 - RNA, 21 nt, Artificial Sequence
  Guide Sequence
uaagagcuuugugagaggagg

SEQ ID NO: 16499 - RNA, 21 nt, Artificial Sequence
  Guide Sequence
uacuucccugucuccucugag

SEQ ID NO: 16500 - RNA, 21 nt, Artificial Sequence
  Guide Sequence
uaggucuuuggcuggagagug

SEQ ID NO: 16501 - RNA, 21 nt, Artificial Sequence
  Guide Sequence
uaugacauucuaagagcuuug

SEQ ID NO: 16502 - RNA, 21 nt, Artificial Sequence
  Guide Sequence
ucaccacuugcuuugugugau

SEQ ID NO: 16503 - RNA, 21 nt, Artificial Sequence
  Guide Sequence
ucaggggaaaccagagacaga

SEQ ID NO: 16504 - RNA, 21 nt, Artificial Sequence
  Guide Sequence
ucccgccccaagagggagaga

SEQ ID NO: 16505 - RNA, 21 nt, Artificial Sequence
  Guide Sequence
ucccugucuccucugagcucu

SEQ ID NO: 16506 - RNA, 21 nt, Artificial Sequence
  Guide Sequence
uccucugagcucuuucccgcc

SEQ ID NO: 16507 - RNA, 21 nt, Artificial Sequence
  Guide Sequence
ucgauaacuugguacuccaag

SEQ ID NO: 16508 - RNA, 21 nt, Artificial Sequence
  Guide Sequence
ucgugcuuuucccacuguuuu

SEQ ID NO: 16509 - RNA, 21 nt, Artificial Sequence
  Guide Sequence
ucuaagagcuuugugagagga

SEQ ID NO: 16510 - RNA, 21 nt, Artificial Sequence
  Guide Sequence
ucuccucugagcucuuucccg

SEQ ID NO: 16511 - RNA, 21 nt, Artificial Sequence
  Guide Sequence
ucugagcucuuucccgcccca

SEQ ID NO: 16512 - RNA, 21 nt, Artificial Sequence
  Guide Sequence
ucuuucccgccccaagaggga

SEQ ID NO: 16513 - RNA, 21 nt, Artificial Sequence
  Guide Sequence
ucuuuggcuggagagugggga

SEQ ID NO: 16514 - RNA, 21 nt, Artificial Sequence
  Guide Sequence
ugaaucgugcuuuucccacug

SEQ ID NO: 16515 - RNA, 21 nt, Artificial Sequence
  Guide Sequence
ugacauucgauaacuugguac

SEQ ID NO: 16516 - RNA, 21 nt, Artificial Sequence
  Guide Sequence
ugacauucuaagagcuuugug

SEQ ID NO: 16517 - RNA, 21 nt, Artificial Sequence
  Guide Sequence
ugaccccuggcacaaaccaua

SEQ ID NO: 16518 - RNA, 21 nt, Artificial Sequence
  Guide Sequence
ugacugaaucgugcuuuuccc

SEQ ID NO: 16519 - RNA, 21 nt, Artificial Sequence
  Guide Sequence
ugagaggaggaccuguggcuu

SEQ ID NO: 16520 - RNA, 21 nt, Artificial Sequence
  Guide Sequence
ugagccucaggggaaaccaga

SEQ ID NO: 16521 - RNA, 21 nt, Artificial Sequence
  Guide Sequence
ugagcucuuucccgccccaag

SEQ ID NO: 16522 - RNA, 21 nt, Artificial Sequence
  Guide Sequence
ugaggaacuuaggucuuuggc

SEQ ID NO: 16523 - RNA, 21 nt, Artificial Sequence
  Guide Sequence
ugaugugacauucgauaacuu

SEQ ID NO: 16524 - RNA, 21 nt, Artificial Sequence
  Guide Sequence
ugcuuugugugaugugacauu

SEQ ID NO: 16525 - RNA, 21 nt, Artificial Sequence
  Guide Sequence
ugcuuuucccacuguuuuggu

SEQ ID NO: 16526 - RNA, 21 nt, Artificial Sequence
  Guide Sequence
uggagaguggggagcugggug

SEQ ID NO: 16527 - RNA, 21 nt, Artificial Sequence
  Guide Sequence
uggcacaaaccauacuucccu

SEQ ID NO: 16528 - RNA, 21 nt, Artificial Sequence
  Guide Sequence
uggcuggagaguggggagcug

SEQ ID NO: 16529 - RNA, 21 nt, Artificial Sequence
  Guide Sequence
uggcuuugagccucaggggaa

SEQ ID NO: 16530 - RNA, 21 nt, Artificial Sequence
  Guide Sequence
uggggagcugggugaccccug

SEQ ID NO: 16531 - RNA, 21 nt, Artificial Sequence
  Guide Sequence
ugggugaccccuggcacaaac

SEQ ID NO: 16532 - RNA, 21 nt, Artificial Sequence
  Guide Sequence
ugguacuccaaguuuuuauga

SEQ ID NO: 16533 - RNA, 21 nt, Artificial Sequence
  Guide Sequence
ugguugugucaccacuugcuu

SEQ ID NO: 16534 - RNA, 21 nt, Artificial Sequence
  Guide Sequence
ugucaccacuugcuuugugug

SEQ ID NO: 16535 - RNA, 21 nt, Artificial Sequence
  Guide Sequence
ugucuccucugagcucuuucc

SEQ ID NO: 16536 - RNA, 21 nt, Artificial Sequence
  Guide Sequence
ugugacauucgauaacuuggu

SEQ ID NO: 16537 - RNA, 21 nt, Artificial Sequence
  Guide Sequence
ugugagaggaggaccuguggc

SEQ ID NO: 16538 - RNA, 21 nt, Artificial Sequence
  Guide Sequence
ugugaugugacauucgauaac

SEQ ID NO: 16539 - RNA, 21 nt, Artificial Sequence
  Guide Sequence
uguggcuuugagccucagggg

SEQ ID NO: 16540 - RNA, 21 nt, Artificial Sequence
  Guide Sequence
ugugucaccacuugcuuugug

SEQ ID NO: 16541 - RNA, 21 nt, Artificial Sequence
  Guide Sequence
ugugugaugugacauucgaua

SEQ ID NO: 16542 - RNA, 21 nt, Artificial Sequence
  Guide Sequence
uuaggucuuuggcuggagagu

SEQ ID NO: 16543 - RNA, 21 nt, Artificial Sequence
  Guide Sequence
uucccgccccaagagggagag

SEQ ID NO: 16544 - RNA, 21 nt, Artificial Sequence
  Guide Sequence
uucccugucuccucugagcuc

SEQ ID NO: 16545 - RNA, 21 nt, Artificial Sequence
  Guide Sequence
uucgauaacuugguacuccaa

SEQ ID NO: 16546 - RNA, 21 nt, Artificial Sequence
  Guide Sequence
uucuaagagcuuugugagagg

SEQ ID NO: 16547 - RNA, 21 nt, Artificial Sequence
  Guide Sequence
uugagccucaggggaaaccag

SEQ ID NO: 16548 - RNA, 21 nt, Artificial Sequence
  Guide Sequence
uugcuuugugugaugugacau

SEQ ID NO: 16549 - RNA, 21 nt, Artificial Sequence
  Guide Sequence
uuggcuggagaguggggagcu

SEQ ID NO: 16550 - RNA, 21 nt, Artificial Sequence
  Guide Sequence
uugguacuccaaguuuuuaug

SEQ ID NO: 16551 - RNA, 21 nt, Artificial Sequence
  Guide Sequence
uugguugugucaccacuugcu

SEQ ID NO: 16552 - RNA, 21 nt, Artificial Sequence
  Guide Sequence
uugugagaggaggaccugugg

SEQ ID NO: 16553 - RNA, 21 nt, Artificial Sequence
  Guide Sequence
uugugucaccacuugcuuugu

SEQ ID NO: 16554 - RNA, 21 nt, Artificial Sequence
  Guide Sequence
uugugugaugugacauucgau

SEQ ID NO: 16555 - RNA, 21 nt, Artificial Sequence
  Guide Sequence
uuucccgccccaagagggaga

SEQ ID NO: 16556 - RNA, 21 nt, Artificial Sequence
  Guide Sequence
uuugagccucaggggaaacca

SEQ ID NO: 16557 - RNA, 21 nt, Artificial Sequence
  Guide Sequence
uuuggcuggagaguggggagc

SEQ ID NO: 16558 - RNA, 21 nt, Artificial Sequence
  Guide Sequence
uuugugagaggaggaccugug

SEQ ID NO: 16559 - RNA, 21 nt, Artificial Sequence
  Guide Sequence
uuugugugaugugacauucga

SEQ ID NO: 16560 - RNA, 22 nt, Artificial Sequence
  Guide Sequence
aaaccauacuucccugucuccu

SEQ ID NO: 16561 - RNA, 22 nt, Artificial Sequence
  Guide Sequence
aaacccuugguugugucaccac

SEQ ID NO: 16562 - RNA, 22 nt, Artificial Sequence
  Guide Sequence
aaccauacuucccugucuccuc

SEQ ID NO: 16563 - RNA, 22 nt, Artificial Sequence
  Guide Sequence
aacccuugguugugucaccacu

SEQ ID NO: 16564 - RNA, 22 nt, Artificial Sequence
  Guide Sequence
aacuuaggucuuuggcuggaga

SEQ ID NO: 16565 - RNA, 22 nt, Artificial Sequence
  Guide Sequence
aacuugguacuccaaguuuuua

SEQ ID NO: 16566 - RNA, 22 nt, Artificial Sequence
  Guide Sequence
aagagcuuugugagaggaggac

SEQ ID NO: 16567 - RNA, 22 nt, Artificial Sequence
  Guide Sequence
aagagggagagaaacccuuggu

SEQ ID NO: 16568 - RNA, 22 nt, Artificial Sequence
  Guide Sequence
aaucgugcuuuucccacuguuu

SEQ ID NO: 16569 - RNA, 22 nt, Artificial Sequence
  Guide Sequence
acaaaccauacuucccugucuc

SEQ ID NO: 16570 - RNA, 22 nt, Artificial Sequence
  Guide Sequence
acauucgauaacuugguacucc

SEQ ID NO: 16571 - RNA, 22 nt, Artificial Sequence
  Guide Sequence
acauucuaagagcuuugugaga

SEQ ID NO: 16572 - RNA, 22 nt, Artificial Sequence
  Guide Sequence
accacuugcuuugugugaugug

SEQ ID NO: 16573 - RNA, 22 nt, Artificial Sequence
  Guide Sequence
accauacuucccugucuccucu

SEQ ID NO: 16574 - RNA, 22 nt, Artificial Sequence
  Guide Sequence
accccuggcacaaaccauacuu

SEQ ID NO: 16575 - RNA, 22 nt, Artificial Sequence
  Guide Sequence
acccuugguugugucaccacuu

SEQ ID NO: 16576 - RNA, 22 nt, Artificial Sequence
  Guide Sequence
accuguggcuuugagccucagg

SEQ ID NO: 16577 - RNA, 22 nt, Artificial Sequence
  Guide Sequence
acuccaaguuuuuaugacauuc

SEQ ID NO: 16578 - RNA, 22 nt, Artificial Sequence
  Guide Sequence
acugaaucgugcuuuucccacu

SEQ ID NO: 16579 - RNA, 22 nt, Artificial Sequence
  Guide Sequence
acuuaggucuuuggcuggagag

SEQ ID NO: 16580 - RNA, 22 nt, Artificial Sequence
  Guide Sequence
acuucccugucuccucugagcu

SEQ ID NO: 16581 - RNA, 22 nt, Artificial Sequence
  Guide Sequence
acuugcuuugugugaugugaca

SEQ ID NO: 16582 - RNA, 22 nt, Artificial Sequence
  Guide Sequence
acuugguacuccaaguuuuuau

SEQ ID NO: 16583 - RNA, 22 nt, Artificial Sequence
  Guide Sequence
agaaacccuugguugugucacc

SEQ ID NO: 16584 - RNA, 22 nt, Artificial Sequence
  Guide Sequence
agagaaacccuugguuguguca

SEQ ID NO: 16585 - RNA, 22 nt, Artificial Sequence
  Guide Sequence
agagcuuugugagaggaggacc

SEQ ID NO: 16586 - RNA, 22 nt, Artificial Sequence
  Guide Sequence
agaggaggaccuguggcuuuga

SEQ ID NO: 16587 - RNA, 22 nt, Artificial Sequence
  Guide Sequence
agagggagagaaacccuugguu

SEQ ID NO: 16588 - RNA, 22 nt, Artificial Sequence
  Guide Sequence
agaguggggagcugggugaccc

SEQ ID NO: 16589 - RNA, 22 nt, Artificial Sequence
  Guide Sequence
agaugacugaaucgugcuuuuc

SEQ ID NO: 16590 - RNA, 22 nt, Artificial Sequence
  Guide Sequence
agccucaggggaaaccagagac

SEQ ID NO: 16591 - RNA, 22 nt, Artificial Sequence
  Guide Sequence
agcucuuucccgccccaagagg

SEQ ID NO: 16592 - RNA, 22 nt, Artificial Sequence
  Guide Sequence
agcugggugaccccuggcacaa

SEQ ID NO: 16593 - RNA, 22 nt, Artificial Sequence
  Guide Sequence
agcuuugugagaggaggaccug

SEQ ID NO: 16594 - RNA, 22 nt, Artificial Sequence
  Guide Sequence
aggaacuuaggucuuuggcugg

SEQ ID NO: 16595 - RNA, 22 nt, Artificial Sequence
  Guide Sequence
aggaccuguggcuuugagccuc

SEQ ID NO: 16596 - RNA, 22 nt, Artificial Sequence
  Guide Sequence
aggaggaccuguggcuuugagc

SEQ ID NO: 16597 - RNA, 22 nt, Artificial Sequence
  Guide Sequence
agggagagaaacccuugguugu

SEQ ID NO: 16598 - RNA, 22 nt, Artificial Sequence
  Guide Sequence
aggucuuuggcuggagaguggg

SEQ ID NO: 16599 - RNA, 22 nt, Artificial Sequence
  Guide Sequence
aguggggagcugggugaccccu

SEQ ID NO: 16600 - RNA, 22 nt, Artificial Sequence
  Guide Sequence
auaacuugguacuccaaguuuu

SEQ ID NO: 16601 - RNA, 22 nt, Artificial Sequence
  Guide Sequence
auacuucccugucuccucugag

SEQ ID NO: 16602 - RNA, 22 nt, Artificial Sequence
  Guide Sequence
aucgugcuuuucccacuguuuu

SEQ ID NO: 16603 - RNA, 22 nt, Artificial Sequence
  Guide Sequence
augacauucuaagagcuuugug

SEQ ID NO: 16604 - RNA, 22 nt, Artificial Sequence
  Guide Sequence
augacugaaucgugcuuuuccc

SEQ ID NO: 16605 - RNA, 22 nt, Artificial Sequence
  Guide Sequence
augugacauucgauaacuuggu

SEQ ID NO: 16606 - RNA, 22 nt, Artificial Sequence
  Guide Sequence
auucgauaacuugguacuccaa

SEQ ID NO: 16607 - RNA, 22 nt, Artificial Sequence
  Guide Sequence
auucuaagagcuuugugagagg

SEQ ID NO: 16608 - RNA, 22 nt, Artificial Sequence
  Guide Sequence
caaaccauacuucccugucucc

SEQ ID NO: 16609 - RNA, 22 nt, Artificial Sequence
  Guide Sequence
caagagggagagaaacccuugg

SEQ ID NO: 16610 - RNA, 22 nt, Artificial Sequence
  Guide Sequence
cacaaaccauacuucccugucu

SEQ ID NO: 16611 - RNA, 22 nt, Artificial Sequence
  Guide Sequence
caccacuugcuuugugugaugu

SEQ ID NO: 16612 - RNA, 22 nt, Artificial Sequence
  Guide Sequence
cacuugcuuugugugaugugac

SEQ ID NO: 16613 - RNA, 22 nt, Artificial Sequence
  Guide Sequence
caggggaaaccagagacagaug

SEQ ID NO: 16614 - RNA, 22 nt, Artificial Sequence
  Guide Sequence
cauacuucccugucuccucuga

SEQ ID NO: 16615 - RNA, 22 nt, Artificial Sequence
  Guide Sequence
cauucgauaacuugguacucca

SEQ ID NO: 16616 - RNA, 22 nt, Artificial Sequence
  Guide Sequence
cauucuaagagcuuugugagag

SEQ ID NO: 16617 - RNA, 22 nt, Artificial Sequence
  Guide Sequence
ccaagagggagagaaacccuug

SEQ ID NO: 16618 - RNA, 22 nt, Artificial Sequence
  Guide Sequence
ccacuugcuuugugugauguga

SEQ ID NO: 16619 - RNA, 22 nt, Artificial Sequence
  Guide Sequence
ccauacuucccugucuccucug

SEQ ID NO: 16620 - RNA, 22 nt, Artificial Sequence
  Guide Sequence
cccaagagggagagaaacccuu

SEQ ID NO: 16621 - RNA, 22 nt, Artificial Sequence
  Guide Sequence
ccccaagagggagagaaacccu

SEQ ID NO: 16622 - RNA, 22 nt, Artificial Sequence
  Guide Sequence
ccccuggcacaaaccauacuuc

SEQ ID NO: 16623 - RNA, 22 nt, Artificial Sequence
  Guide Sequence
cccgccccaagagggagagaaa

SEQ ID NO: 16624 - RNA, 22 nt, Artificial Sequence
  Guide Sequence
cccuggcacaaaccauacuucc

SEQ ID NO: 16625 - RNA, 22 nt, Artificial Sequence
  Guide Sequence
cccugucuccucugagcucuuu

SEQ ID NO: 16626 - RNA, 22 nt, Artificial Sequence
  Guide Sequence
cccuugguugugucaccacuug

SEQ ID NO: 16627 - RNA, 22 nt, Artificial Sequence
  Guide Sequence
ccgccccaagagggagagaaac

SEQ ID NO: 16628 - RNA, 22 nt, Artificial Sequence
  Guide Sequence
ccucaggggaaaccagagacag

SEQ ID NO: 16629 - RNA, 22 nt, Artificial Sequence
  Guide Sequence
ccucugagcucuuucccgcccc

SEQ ID NO: 16630 - RNA, 22 nt, Artificial Sequence
  Guide Sequence
ccuggcacaaaccauacuuccc

SEQ ID NO: 16631 - RNA, 22 nt, Artificial Sequence
  Guide Sequence
ccugucuccucugagcucuuuc

SEQ ID NO: 16632 - RNA, 22 nt, Artificial Sequence
  Guide Sequence
ccuguggcuuugagccucaggg

SEQ ID NO: 16633 - RNA, 22 nt, Artificial Sequence
  Guide Sequence
ccuugguugugucaccacuugc

SEQ ID NO: 16634 - RNA, 22 nt, Artificial Sequence
  Guide Sequence
cgauaacuugguacuccaaguu

SEQ ID NO: 16635 - RNA, 22 nt, Artificial Sequence
  Guide Sequence
cgccccaagagggagagaaacc

SEQ ID NO: 16636 - RNA, 22 nt, Artificial Sequence
  Guide Sequence
cgugcuuuucccacuguuuugg

SEQ ID NO: 16637 - RNA, 22 nt, Artificial Sequence
  Guide Sequence
cuaagagcuuugugagaggagg

SEQ ID NO: 16638 - RNA, 22 nt, Artificial Sequence
  Guide Sequence
cucaggggaaaccagagacaga

SEQ ID NO: 16639 - RNA, 22 nt, Artificial Sequence
  Guide Sequence
cuccaaguuuuuaugacauucu

SEQ ID NO: 16640 - RNA, 22 nt, Artificial Sequence
  Guide Sequence
cuccucugagcucuuucccgcc

SEQ ID NO: 16641 - RNA, 22 nt, Artificial Sequence
  Guide Sequence
cucugagcucuuucccgcccca

SEQ ID NO: 16642 - RNA, 22 nt, Artificial Sequence
  Guide Sequence
cucuuucccgccccaagaggga

SEQ ID NO: 16643 - RNA, 22 nt, Artificial Sequence
  Guide Sequence
cugaaucgugcuuuucccacug

SEQ ID NO: 16644 - RNA, 22 nt, Artificial Sequence
  Guide Sequence
cugagcucuuucccgccccaag

SEQ ID NO: 16645 - RNA, 22 nt, Artificial Sequence
  Guide Sequence
cuggagaguggggagcugggug

SEQ ID NO: 16646 - RNA, 22 nt, Artificial Sequence
  Guide Sequence
cuggcacaaaccauacuucccu

SEQ ID NO: 16647 - RNA, 22 nt, Artificial Sequence
  Guide Sequence
cugggugaccccuggcacaaac

SEQ ID NO: 16648 - RNA, 22 nt, Artificial Sequence
  Guide Sequence
cugucuccucugagcucuuucc

SEQ ID NO: 16649 - RNA, 22 nt, Artificial Sequence
  Guide Sequence
cuguggcuuugagccucagggg

SEQ ID NO: 16650 - RNA, 22 nt, Artificial Sequence
  Guide Sequence
cuuaggucuuuggcuggagagu

SEQ ID NO: 16651 - RNA, 22 nt, Artificial Sequence
  Guide Sequence
cuucccugucuccucugagcuc

SEQ ID NO: 16652 - RNA, 22 nt, Artificial Sequence
  Guide Sequence
cuugcuuugugugaugugacau

SEQ ID NO: 16653 - RNA, 22 nt, Artificial Sequence
  Guide Sequence
cuugguacuccaaguuuuuaug

SEQ ID NO: 16654 - RNA, 22 nt, Artificial Sequence
  Guide Sequence
cuugguugugucaccacuugcu

SEQ ID NO: 16655 - RNA, 22 nt, Artificial Sequence
  Guide Sequence
cuuucccgccccaagagggaga

SEQ ID NO: 16656 - RNA, 22 nt, Artificial Sequence
  Guide Sequence
cuuugagccucaggggaaacca

SEQ ID NO: 16657 - RNA, 22 nt, Artificial Sequence
  Guide Sequence
cuuuggcuggagaguggggagc

SEQ ID NO: 16658 - RNA, 22 nt, Artificial Sequence
  Guide Sequence
cuuugugagaggaggaccugug

SEQ ID NO: 16659 - RNA, 22 nt, Artificial Sequence
  Guide Sequence
cuuugugugaugugacauucga

SEQ ID NO: 16660 - RNA, 22 nt, Artificial Sequence
  Guide Sequence
gaaacccuugguugugucacca

SEQ ID NO: 16661 - RNA, 22 nt, Artificial Sequence
  Guide Sequence
gaacuuaggucuuuggcuggag

SEQ ID NO: 16662 - RNA, 22 nt, Artificial Sequence
  Guide Sequence
gaaucgugcuuuucccacuguu

SEQ ID NO: 16663 - RNA, 22 nt, Artificial Sequence
  Guide Sequence
gacauucgauaacuugguacuc

SEQ ID NO: 16664 - RNA, 22 nt, Artificial Sequence
  Guide Sequence
gacauucuaagagcuuugugag

SEQ ID NO: 16665 - RNA, 22 nt, Artificial Sequence
  Guide Sequence
gaccccuggcacaaaccauacu

SEQ ID NO: 16666 - RNA, 22 nt, Artificial Sequence
  Guide Sequence
gaccuguggcuuugagccucag

SEQ ID NO: 16667 - RNA, 22 nt, Artificial Sequence
  Guide Sequence
gacugaaucgugcuuuucccac

SEQ ID NO: 16668 - RNA, 22 nt, Artificial Sequence
  Guide Sequence
gagaaacccuugguugugucac

SEQ ID NO: 16669 - RNA, 22 nt, Artificial Sequence
  Guide Sequence
gagagaaacccuugguuguguc

SEQ ID NO: 16670 - RNA, 22 nt, Artificial Sequence
  Guide Sequence
gagaggaggaccuguggcuuug

SEQ ID NO: 16671 - RNA, 22 nt, Artificial Sequence
  Guide Sequence
gagaguggggagcugggugacc

SEQ ID NO: 16672 - RNA, 22 nt, Artificial Sequence
  Guide Sequence
gagaugacugaaucgugcuuuu

SEQ ID NO: 16673 - RNA, 22 nt, Artificial Sequence
  Guide Sequence
gagccucaggggaaaccagaga

SEQ ID NO: 16674 - RNA, 22 nt, Artificial Sequence
  Guide Sequence
gagcucuuucccgccccaagag

SEQ ID NO: 16675 - RNA, 22 nt, Artificial Sequence
  Guide Sequence
gagcugggugaccccuggcaca

SEQ ID NO: 16676 - RNA, 22 nt, Artificial Sequence
  Guide Sequence
gagcuuugugagaggaggaccu

SEQ ID NO: 16677 - RNA, 22 nt, Artificial Sequence
  Guide Sequence
gaggaacuuaggucuuuggcug

SEQ ID NO: 16678 - RNA, 22 nt, Artificial Sequence
  Guide Sequence
gaggaccuguggcuuugagccu

SEQ ID NO: 16679 - RNA, 22 nt, Artificial Sequence
  Guide Sequence
gaggaggaccuguggcuuugag

SEQ ID NO: 16680 - RNA, 22 nt, Artificial Sequence
  Guide Sequence
gagggagagaaacccuugguug

SEQ ID NO: 16681 - RNA, 22 nt, Artificial Sequence
  Guide Sequence
gaguggggagcugggugacccc

SEQ ID NO: 16682 - RNA, 22 nt, Artificial Sequence
  Guide Sequence
gauaacuugguacuccaaguuu

SEQ ID NO: 16683 - RNA, 22 nt, Artificial Sequence
  Guide Sequence
gaugacugaaucgugcuuuucc

SEQ ID NO: 16684 - RNA, 22 nt, Artificial Sequence
  Guide Sequence
gaugugacauucgauaacuugg

SEQ ID NO: 16685 - RNA, 22 nt, Artificial Sequence
  Guide Sequence
gcacaaaccauacuucccuguc

SEQ ID NO: 16686 - RNA, 22 nt, Artificial Sequence
  Guide Sequence
gccccaagagggagagaaaccc

SEQ ID NO: 16687 - RNA, 22 nt, Artificial Sequence
  Guide Sequence
gccucaggggaaaccagagaca

SEQ ID NO: 16688 - RNA, 22 nt, Artificial Sequence
  Guide Sequence
gcucuuucccgccccaagaggg

SEQ ID NO: 16689 - RNA, 22 nt, Artificial Sequence
  Guide Sequence
gcuggagaguggggagcugggu

SEQ ID NO: 16690 - RNA, 22 nt, Artificial Sequence
  Guide Sequence
gcugggugaccccuggcacaaa

SEQ ID NO: 16691 - RNA, 22 nt, Artificial Sequence
  Guide Sequence
gcuuugagccucaggggaaacc

SEQ ID NO: 16692 - RNA, 22 nt, Artificial Sequence
  Guide Sequence
gcuuugugagaggaggaccugu

SEQ ID NO: 16693 - RNA, 22 nt, Artificial Sequence
  Guide Sequence
gcuuugugugaugugacauucg

SEQ ID NO: 16694 - RNA, 22 nt, Artificial Sequence
  Guide Sequence
ggaacuuaggucuuuggcugga

SEQ ID NO: 16695 - RNA, 22 nt, Artificial Sequence
  Guide Sequence
ggaccuguggcuuugagccuca

SEQ ID NO: 16696 - RNA, 22 nt, Artificial Sequence
  Guide Sequence
ggagagaaacccuugguugugu

SEQ ID NO: 16697 - RNA, 22 nt, Artificial Sequence
  Guide Sequence
ggagaguggggagcugggugac

SEQ ID NO: 16698 - RNA, 22 nt, Artificial Sequence
  Guide Sequence
ggagaugacugaaucgugcuuu

SEQ ID NO: 16699 - RNA, 22 nt, Artificial Sequence
  Guide Sequence
ggagcugggugaccccuggcac

SEQ ID NO: 16700 - RNA, 22 nt, Artificial Sequence
  Guide Sequence
ggaggaccuguggcuuugagcc

SEQ ID NO: 16701 - RNA, 22 nt, Artificial Sequence
  Guide Sequence
ggcacaaaccauacuucccugu

SEQ ID NO: 16702 - RNA, 22 nt, Artificial Sequence
  Guide Sequence
ggcuggagaguggggagcuggg

SEQ ID NO: 16703 - RNA, 22 nt, Artificial Sequence
  Guide Sequence
ggcuuugagccucaggggaaac

SEQ ID NO: 16704 - RNA, 22 nt, Artificial Sequence
  Guide Sequence
gggagagaaacccuugguugug

SEQ ID NO: 16705 - RNA, 22 nt, Artificial Sequence
  Guide Sequence
gggagcugggugaccccuggca

SEQ ID NO: 16706 - RNA, 22 nt, Artificial Sequence
  Guide Sequence
ggggagcugggugaccccuggc

SEQ ID NO: 16707 - RNA, 22 nt, Artificial Sequence
  Guide Sequence
gggugaccccuggcacaaacca

SEQ ID NO: 16708 - RNA, 22 nt, Artificial Sequence
  Guide Sequence
gguacuccaaguuuuuaugaca

SEQ ID NO: 16709 - RNA, 22 nt, Artificial Sequence
  Guide Sequence
ggucuuuggcuggagagugggg

SEQ ID NO: 16710 - RNA, 22 nt, Artificial Sequence
  Guide Sequence
ggugaccccuggcacaaaccau

SEQ ID NO: 16711 - RNA, 22 nt, Artificial Sequence
  Guide Sequence
ggugaggaacuuaggucuuugg

SEQ ID NO: 16712 - RNA, 22 nt, Artificial Sequence
  Guide Sequence
gguugugucaccacuugcuuug

SEQ ID NO: 16713 - RNA, 22 nt, Artificial Sequence
  Guide Sequence
guacuccaaguuuuuaugacau

SEQ ID NO: 16714 - RNA, 22 nt, Artificial Sequence
  Guide Sequence
gucaccacuugcuuugugugau

SEQ ID NO: 16715 - RNA, 22 nt, Artificial Sequence
  Guide Sequence
gucuccucugagcucuuucccg

SEQ ID NO: 16716 - RNA, 22 nt, Artificial Sequence
  Guide Sequence
gucuuuggcuggagagugggga

SEQ ID NO: 16717 - RNA, 22 nt, Artificial Sequence
  Guide Sequence
gugacauucgauaacuugguac

SEQ ID NO: 16718 - RNA, 22 nt, Artificial Sequence
  Guide Sequence
gugaccccuggcacaaaccaua

SEQ ID NO: 16719 - RNA, 22 nt, Artificial Sequence
  Guide Sequence
gugagaggaggaccuguggcuu

SEQ ID NO: 16720 - RNA, 22 nt, Artificial Sequence
  Guide Sequence
gugaggaacuuaggucuuuggc

SEQ ID NO: 16721 - RNA, 22 nt, Artificial Sequence
  Guide Sequence
gugaugugacauucgauaacuu

SEQ ID NO: 16722 - RNA, 22 nt, Artificial Sequence
  Guide Sequence
gugcuuuucccacuguuuuggu

SEQ ID NO: 16723 - RNA, 22 nt, Artificial Sequence
  Guide Sequence
guggcuuugagccucaggggaa

SEQ ID NO: 16724 - RNA, 22 nt, Artificial Sequence
  Guide Sequence
guggggagcugggugaccccug

SEQ ID NO: 16725 - RNA, 22 nt, Artificial Sequence
  Guide Sequence
gugucaccacuugcuuugugug

SEQ ID NO: 16726 - RNA, 22 nt, Artificial Sequence
  Guide Sequence
gugugaugugacauucgauaac

SEQ ID NO: 16727 - RNA, 22 nt, Artificial Sequence
  Guide Sequence
guugugucaccacuugcuuugu

SEQ ID NO: 16728 - RNA, 22 nt, Artificial Sequence
  Guide Sequence
guuuuuaugacauucuaagagc

SEQ ID NO: 16729 - RNA, 22 nt, Artificial Sequence
  Guide Sequence
uaacuugguacuccaaguuuuu

SEQ ID NO: 16730 - RNA, 22 nt, Artificial Sequence
  Guide Sequence
uaagagcuuugugagaggagga

SEQ ID NO: 16731 - RNA, 22 nt, Artificial Sequence
  Guide Sequence
uacuucccugucuccucugagc

SEQ ID NO: 16732 - RNA, 22 nt, Artificial Sequence
  Guide Sequence
uaggucuuuggcuggagagugg

SEQ ID NO: 16733 - RNA, 22 nt, Artificial Sequence
  Guide Sequence
uaugacauucuaagagcuuugu

SEQ ID NO: 16734 - RNA, 22 nt, Artificial Sequence
  Guide Sequence
ucaccacuugcuuugugugaug

SEQ ID NO: 16735 - RNA, 22 nt, Artificial Sequence
  Guide Sequence
ucaggggaaaccagagacagau

SEQ ID NO: 16736 - RNA, 22 nt, Artificial Sequence
  Guide Sequence
ucccgccccaagagggagagaa

SEQ ID NO: 16737 - RNA, 22 nt, Artificial Sequence
  Guide Sequence
ucccugucuccucugagcucuu

SEQ ID NO: 16738 - RNA, 22 nt, Artificial Sequence
  Guide Sequence
uccucugagcucuuucccgccc

SEQ ID NO: 16739 - RNA, 22 nt, Artificial Sequence
  Guide Sequence
ucgauaacuugguacuccaagu

SEQ ID NO: 16740 - RNA, 22 nt, Artificial Sequence
  Guide Sequence
ucgugcuuuucccacuguuuug

SEQ ID NO: 16741 - RNA, 22 nt, Artificial Sequence
  Guide Sequence
ucuaagagcuuugugagaggag

SEQ ID NO: 16742 - RNA, 22 nt, Artificial Sequence
  Guide Sequence
ucuccucugagcucuuucccgc

SEQ ID NO: 16743 - RNA, 22 nt, Artificial Sequence
  Guide Sequence
ucugagcucuuucccgccccaa

SEQ ID NO: 16744 - RNA, 22 nt, Artificial Sequence
  Guide Sequence
ucuuucccgccccaagagggag

SEQ ID NO: 16745 - RNA, 22 nt, Artificial Sequence
  Guide Sequence
ucuuuggcuggagaguggggag

SEQ ID NO: 16746 - RNA, 22 nt, Artificial Sequence
  Guide Sequence
ugaaucgugcuuuucccacugu

SEQ ID NO: 16747 - RNA, 22 nt, Artificial Sequence
  Guide Sequence
ugacauucgauaacuugguacu

SEQ ID NO: 16748 - RNA, 22 nt, Artificial Sequence
  Guide Sequence
ugacauucuaagagcuuuguga

SEQ ID NO: 16749 - RNA, 22 nt, Artificial Sequence
  Guide Sequence
ugaccccuggcacaaaccauac

SEQ ID NO: 16750 - RNA, 22 nt, Artificial Sequence
  Guide Sequence
ugacugaaucgugcuuuuccca

SEQ ID NO: 16751 - RNA, 22 nt, Artificial Sequence
  Guide Sequence
ugagaggaggaccuguggcuuu

SEQ ID NO: 16752 - RNA, 22 nt, Artificial Sequence
  Guide Sequence
ugagccucaggggaaaccagag

SEQ ID NO: 16753 - RNA, 22 nt, Artificial Sequence
  Guide Sequence
ugagcucuuucccgccccaaga

SEQ ID NO: 16754 - RNA, 22 nt, Artificial Sequence
  Guide Sequence
ugaggaacuuaggucuuuggcu

SEQ ID NO: 16755 - RNA, 22 nt, Artificial Sequence
  Guide Sequence
ugaugugacauucgauaacuug

SEQ ID NO: 16756 - RNA, 22 nt, Artificial Sequence
  Guide Sequence
ugcuuugugugaugugacauuc

SEQ ID NO: 16757 - RNA, 22 nt, Artificial Sequence
  Guide Sequence
uggagaguggggagcuggguga

SEQ ID NO: 16758 - RNA, 22 nt, Artificial Sequence
  Guide Sequence
uggcacaaaccauacuucccug

SEQ ID NO: 16759 - RNA, 22 nt, Artificial Sequence
  Guide Sequence
uggcuggagaguggggagcugg

SEQ ID NO: 16760 - RNA, 22 nt, Artificial Sequence
  Guide Sequence
uggcuuugagccucaggggaaa

SEQ ID NO: 16761 - RNA, 22 nt, Artificial Sequence
  Guide Sequence
uggggagcugggugaccccugg

SEQ ID NO: 16762 - RNA, 22 nt, Artificial Sequence
  Guide Sequence
ugggugaccccuggcacaaacc

SEQ ID NO: 16763 - RNA, 22 nt, Artificial Sequence
  Guide Sequence
ugguacuccaaguuuuuaugac

SEQ ID NO: 16764 - RNA, 22 nt, Artificial Sequence
  Guide Sequence
ugguugugucaccacuugcuuu

SEQ ID NO: 16765 - RNA, 22 nt, Artificial Sequence
  Guide Sequence
ugucaccacuugcuuuguguga

SEQ ID NO: 16766 - RNA, 22 nt, Artificial Sequence
  Guide Sequence
ugucuccucugagcucuuuccc

SEQ ID NO: 16767 - RNA, 22 nt, Artificial Sequence
  Guide Sequence
ugugacauucgauaacuuggua

SEQ ID NO: 16768 - RNA, 22 nt, Artificial Sequence
  Guide Sequence
ugugagaggaggaccuguggcu

SEQ ID NO: 16769 - RNA, 22 nt, Artificial Sequence
  Guide Sequence
ugugaugugacauucgauaacu

SEQ ID NO: 16770 - RNA, 22 nt, Artificial Sequence
  Guide Sequence
uguggcuuugagccucagggga

SEQ ID NO: 16771 - RNA, 22 nt, Artificial Sequence
  Guide Sequence
ugugucaccacuugcuuugugu

SEQ ID NO: 16772 - RNA, 22 nt, Artificial Sequence
  Guide Sequence
ugugugaugugacauucgauaa

SEQ ID NO: 16773 - RNA, 22 nt, Artificial Sequence
  Guide Sequence
uuaggucuuuggcuggagagug

SEQ ID NO: 16774 - RNA, 22 nt, Artificial Sequence
  Guide Sequence
uuaugacauucuaagagcuuug

SEQ ID NO: 16775 - RNA, 22 nt, Artificial Sequence
  Guide Sequence
uucccgccccaagagggagaga

SEQ ID NO: 16776 - RNA, 22 nt, Artificial Sequence
  Guide Sequence
uucccugucuccucugagcucu

SEQ ID NO: 16777 - RNA, 22 nt, Artificial Sequence
  Guide Sequence
uucgauaacuugguacuccaag

SEQ ID NO: 16778 - RNA, 22 nt, Artificial Sequence
  Guide Sequence
uucuaagagcuuugugagagga

SEQ ID NO: 16779 - RNA, 22 nt, Artificial Sequence
  Guide Sequence
uugagccucaggggaaaccaga

SEQ ID NO: 16780 - RNA, 22 nt, Artificial Sequence
  Guide Sequence
uugcuuugugugaugugacauu

SEQ ID NO: 16781 - RNA, 22 nt, Artificial Sequence
  Guide Sequence
uuggcuggagaguggggagcug

SEQ ID NO: 16782 - RNA, 22 nt, Artificial Sequence
  Guide Sequence
uugguacuccaaguuuuuauga

SEQ ID NO: 16783 - RNA, 22 nt, Artificial Sequence
  Guide Sequence
uugguugugucaccacuugcuu

SEQ ID NO: 16784 - RNA, 22 nt, Artificial Sequence
  Guide Sequence
uugugagaggaggaccuguggc

SEQ ID NO: 16785 - RNA, 22 nt, Artificial Sequence
  Guide Sequence
uugugucaccacuugcuuugug

SEQ ID NO: 16786 - RNA, 22 nt, Artificial Sequence
  Guide Sequence
uugugugaugugacauucgaua

SEQ ID NO: 16787 - RNA, 22 nt, Artificial Sequence
  Guide Sequence
uuucccgccccaagagggagag

SEQ ID NO: 16788 - RNA, 22 nt, Artificial Sequence
  Guide Sequence
uuugagccucaggggaaaccag

SEQ ID NO: 16789 - RNA, 22 nt, Artificial Sequence
  Guide Sequence
uuuggcuggagaguggggagcu

SEQ ID NO: 16790 - RNA, 22 nt, Artificial Sequence
  Guide Sequence
uuugugagaggaggaccugugg

SEQ ID NO: 16791 - RNA, 22 nt, Artificial Sequence
  Guide Sequence
uuugugugaugugacauucgau

SEQ ID NO: 16792 - RNA, 20 nt, Artificial Sequence
  Guide Sequence
aaaacagugagaauuagcug

SEQ ID NO: 16793 - RNA, 20 nt, Artificial Sequence
  Guide Sequence
aaaagcaaacagcacggggc

SEQ ID NO: 16794 - RNA, 20 nt, Artificial Sequence
  Guide Sequence
aaacagcacggggccucacc

SEQ ID NO: 16795 - RNA, 20 nt, Artificial Sequence
  Guide Sequence
aaacagugagaauuagcugu

SEQ ID NO: 16796 - RNA, 20 nt, Artificial Sequence
  Guide Sequence
aaagaaguuggcccuggaga

SEQ ID NO: 16797 - RNA, 20 nt, Artificial Sequence
  Guide Sequence
aaagcaaacagcacggggcc

SEQ ID NO: 16798 - RNA, 20 nt, Artificial Sequence
  Guide Sequence
aaaucucccucucacacuac

SEQ ID NO: 16799 - RNA, 20 nt, Artificial Sequence
  Guide Sequence
aacagcacggggccucaccc

SEQ ID NO: 16800 - RNA, 20 nt, Artificial Sequence
  Guide Sequence
aacagugagaauuagcuguu

SEQ ID NO: 16801 - RNA, 20 nt, Artificial Sequence
  Guide Sequence
aaccacuaaagaaguuggcc

SEQ ID NO: 16802 - RNA, 20 nt, Artificial Sequence
  Guide Sequence
aacgaaugguccugcauagu

SEQ ID NO: 16803 - RNA, 20 nt, Artificial Sequence
  Guide Sequence
aagaaguuggcccuggagau

SEQ ID NO: 16804 - RNA, 20 nt, Artificial Sequence
  Guide Sequence
aagacccuuaaaucucccuc

SEQ ID NO: 16805 - RNA, 20 nt, Artificial Sequence
  Guide Sequence
aagcaaacagcacggggccu

SEQ ID NO: 16806 - RNA, 20 nt, Artificial Sequence
  Guide Sequence
aaggaagagcuagccggggg

SEQ ID NO: 16807 - RNA, 20 nt, Artificial Sequence
  Guide Sequence
aaggaauuguuuaccugaga

SEQ ID NO: 16808 - RNA, 20 nt, Artificial Sequence
  Guide Sequence
aaguuggcccuggagauggu

SEQ ID NO: 16809 - RNA, 20 nt, Artificial Sequence
  Guide Sequence
aaugguccugcauagucugc

SEQ ID NO: 16810 - RNA, 20 nt, Artificial Sequence
  Guide Sequence
aauuagcuguuuacacacaa

SEQ ID NO: 16811 - RNA, 20 nt, Artificial Sequence
  Guide Sequence
aauuccccaacgaauggucc

SEQ ID NO: 16812 - RNA, 20 nt, Artificial Sequence
  Guide Sequence
aauuguuuaccugagaccuu

SEQ ID NO: 16813 - RNA, 20 nt, Artificial Sequence
  Guide Sequence
aauuuagcgacuaucugcuu

SEQ ID NO: 16814 - RNA, 20 nt, Artificial Sequence
  Guide Sequence
acaaggaauuguuuaccuga

SEQ ID NO: 16815 - RNA, 20 nt, Artificial Sequence
  Guide Sequence
acacaaggaauuguuuaccu

SEQ ID NO: 16816 - RNA, 20 nt, Artificial Sequence
  Guide Sequence
acacacaaggaauuguuuac

SEQ ID NO: 16817 - RNA, 20 nt, Artificial Sequence
  Guide Sequence
acagcacggggccucacccc

SEQ ID NO: 16818 - RNA, 20 nt, Artificial Sequence
  Guide Sequence
acagugagaauuagcuguuu

SEQ ID NO: 16819 - RNA, 20 nt, Artificial Sequence
  Guide Sequence
accacuaaagaaguuggccc

SEQ ID NO: 16820 - RNA, 20 nt, Artificial Sequence
  Guide Sequence
acccagggugcagggcuguu

SEQ ID NO: 16821 - RNA, 20 nt, Artificial Sequence
  Guide Sequence
accccgaccucucuggcuga

SEQ ID NO: 16822 - RNA, 20 nt, Artificial Sequence
  Guide Sequence
acccuuaaaucucccucuca

SEQ ID NO: 16823 - RNA, 20 nt, Artificial Sequence
  Guide Sequence
accucucuggcugacuagcc

SEQ ID NO: 16824 - RNA, 20 nt, Artificial Sequence
  Guide Sequence
accugagaccuugaucaaga

SEQ ID NO: 16825 - RNA, 20 nt, Artificial Sequence
  Guide Sequence
accuugaucaagacccuuaa

SEQ ID NO: 16826 - RNA, 20 nt, Artificial Sequence
  Guide Sequence
acgaaugguccugcauaguc

SEQ ID NO: 16827 - RNA, 20 nt, Artificial Sequence
  Guide Sequence
acggggccucaccccgaccu

SEQ ID NO: 16828 - RNA, 20 nt, Artificial Sequence
  Guide Sequence
acuaaagaaguuggcccugg

SEQ ID NO: 16829 - RNA, 20 nt, Artificial Sequence
  Guide Sequence
acuagcccaggcuccaggag

SEQ ID NO: 16830 - RNA, 20 nt, Artificial Sequence
  Guide Sequence
acuaucugcuuucauuagcc

SEQ ID NO: 16831 - RNA, 20 nt, Artificial Sequence
  Guide Sequence
agaaaagcaaacagcacggg

SEQ ID NO: 16832 - RNA, 20 nt, Artificial Sequence
  Guide Sequence
agaaguuggcccuggagaug

SEQ ID NO: 16833 - RNA, 20 nt, Artificial Sequence
  Guide Sequence
agaauuagcuguuuacacac

SEQ ID NO: 16834 - RNA, 20 nt, Artificial Sequence
  Guide Sequence
agacccuuaaaucucccucu

SEQ ID NO: 16835 - RNA, 20 nt, Artificial Sequence
  Guide Sequence
agaccuugaucaagacccuu

SEQ ID NO: 16836 - RNA, 20 nt, Artificial Sequence
  Guide Sequence
agaggcaggcaggaggggau

SEQ ID NO: 16837 - RNA, 20 nt, Artificial Sequence
  Guide Sequence
agagggggcugucaguuucu

SEQ ID NO: 16838 - RNA, 20 nt, Artificial Sequence
  Guide Sequence
agauggugggagugcccacc

SEQ ID NO: 16839 - RNA, 20 nt, Artificial Sequence
  Guide Sequence
agcaaacagcacggggccuc

SEQ ID NO: 16840 - RNA, 20 nt, Artificial Sequence
  Guide Sequence
agcacggggccucaccccga

SEQ ID NO: 16841 - RNA, 20 nt, Artificial Sequence
  Guide Sequence
agcccaggcuccaggagggu

SEQ ID NO: 16842 - RNA, 20 nt, Artificial Sequence
  Guide Sequence
agccccucaggccccuccua

SEQ ID NO: 16843 - RNA, 20 nt, Artificial Sequence
  Guide Sequence
agccuugaggcccggucauc

SEQ ID NO: 16844 - RNA, 20 nt, Artificial Sequence
  Guide Sequence
agcgacuaucugcuuucauu

SEQ ID NO: 16845 - RNA, 20 nt, Artificial Sequence
  Guide Sequence
agcuguuuacacacaaggaa

SEQ ID NO: 16846 - RNA, 20 nt, Artificial Sequence
  Guide Sequence
aggaagagcuagccgggggg

SEQ ID NO: 16847 - RNA, 20 nt, Artificial Sequence
  Guide Sequence
aggaauuguuuaccugagac

SEQ ID NO: 16848 - RNA, 20 nt, Artificial Sequence
  Guide Sequence
aggagagggggcugucaguu

SEQ ID NO: 16849 - RNA, 20 nt, Artificial Sequence
  Guide Sequence
aggaggggauucugcagaaa

SEQ ID NO: 16850 - RNA, 20 nt, Artificial Sequence
  Guide Sequence
aggaggguaauuuagcgacu

SEQ ID NO: 16851 - RNA, 20 nt, Artificial Sequence
  Guide Sequence
aggcaggaggggauucugca

SEQ ID NO: 16852 - RNA, 20 nt, Artificial Sequence
  Guide Sequence
aggcaggcaggaggggauuc

SEQ ID NO: 16853 - RNA, 20 nt, Artificial Sequence
  Guide Sequence
aggccccuccuaucagaggc

SEQ ID NO: 16854 - RNA, 20 nt, Artificial Sequence
  Guide Sequence
aggcccggucaucaauuccc

SEQ ID NO: 16855 - RNA, 20 nt, Artificial Sequence
  Guide Sequence
aggcuccaggaggguaauuu

SEQ ID NO: 16856 - RNA, 20 nt, Artificial Sequence
  Guide Sequence
agggcuguuugucaaggaag

SEQ ID NO: 16857 - RNA, 20 nt, Artificial Sequence
  Guide Sequence
aggggauucugcagaaaagc

SEQ ID NO: 16858 - RNA, 20 nt, Artificial Sequence
  Guide Sequence
agggggcugcauugauggag

SEQ ID NO: 16859 - RNA, 20 nt, Artificial Sequence
  Guide Sequence
agggggcugucaguuucugg

SEQ ID NO: 16860 - RNA, 20 nt, Artificial Sequence
  Guide Sequence
aggguaauuuagcgacuauc

SEQ ID NO: 16861 - RNA, 20 nt, Artificial Sequence
  Guide Sequence
agggugcagggcuguuuguc

SEQ ID NO: 16862 - RNA, 20 nt, Artificial Sequence
  Guide Sequence
aguaaccacuaaagaaguug

SEQ ID NO: 16863 - RNA, 20 nt, Artificial Sequence
  Guide Sequence
aguagccuugaggcccgguc

SEQ ID NO: 16864 - RNA, 20 nt, Artificial Sequence
  Guide Sequence
agucugcccagccccucagg

SEQ ID NO: 16865 - RNA, 20 nt, Artificial Sequence
  Guide Sequence
agugagaauuagcuguuuac

SEQ ID NO: 16866 - RNA, 20 nt, Artificial Sequence
  Guide Sequence
agugcccacccagggugcag

SEQ ID NO: 16867 - RNA, 20 nt, Artificial Sequence
  Guide Sequence
aguguguguuuucaguuucc

SEQ ID NO: 16868 - RNA, 20 nt, Artificial Sequence
  Guide Sequence
aguuggcccuggagauggug

SEQ ID NO: 16869 - RNA, 20 nt, Artificial Sequence
  Guide Sequence
aguuucccuucuuauaaaac

SEQ ID NO: 16870 - RNA, 20 nt, Artificial Sequence
  Guide Sequence
aguuucuggguguuagugug

SEQ ID NO: 16871 - RNA, 20 nt, Artificial Sequence
  Guide Sequence
auaaaacagugagaauuagc

SEQ ID NO: 16872 - RNA, 20 nt, Artificial Sequence
  Guide Sequence
auaguaaccacuaaagaagu

SEQ ID NO: 16873 - RNA, 20 nt, Artificial Sequence
  Guide Sequence
auagucugcccagccccuca

SEQ ID NO: 16874 - RNA, 20 nt, Artificial Sequence
  Guide Sequence
aucaagacccuuaaaucucc

SEQ ID NO: 16875 - RNA, 20 nt, Artificial Sequence
  Guide Sequence
aucaauuccccaacgaaugg

SEQ ID NO: 16876 - RNA, 20 nt, Artificial Sequence
  Guide Sequence
aucagaggcaggcaggaggg

SEQ ID NO: 16877 - RNA, 20 nt, Artificial Sequence
  Guide Sequence
aucugcuuucauuagccugc

SEQ ID NO: 16878 - RNA, 20 nt, Artificial Sequence
  Guide Sequence
auggaguagccuugaggccc

SEQ ID NO: 16879 - RNA, 20 nt, Artificial Sequence
  Guide Sequence
augguccugcauagucugcc

SEQ ID NO: 16880 - RNA, 20 nt, Artificial Sequence
  Guide Sequence
auggugggagugcccaccca

SEQ ID NO: 16881 - RNA, 20 nt, Artificial Sequence
  Guide Sequence
auuagccugcucguuaacuu

SEQ ID NO: 16882 - RNA, 20 nt, Artificial Sequence
  Guide Sequence
auuagcuguuuacacacaag

SEQ ID NO: 16883 - RNA, 20 nt, Artificial Sequence
  Guide Sequence
auuccccaacgaaugguccu

SEQ ID NO: 16884 - RNA, 20 nt, Artificial Sequence
  Guide Sequence
auucugcagaaaagcaaaca

SEQ ID NO: 16885 - RNA, 20 nt, Artificial Sequence
  Guide Sequence
auugauggaguagccuugag

SEQ ID NO: 16886 - RNA, 20 nt, Artificial Sequence
  Guide Sequence
auuguuuaccugagaccuug

SEQ ID NO: 16887 - RNA, 20 nt, Artificial Sequence
  Guide Sequence
auuuagcgacuaucugcuuu

SEQ ID NO: 16888 - RNA, 20 nt, Artificial Sequence
  Guide Sequence
caaacagcacggggccucac

SEQ ID NO: 16889 - RNA, 20 nt, Artificial Sequence
  Guide Sequence
caacgaaugguccugcauag

SEQ ID NO: 16890 - RNA, 20 nt, Artificial Sequence
  Guide Sequence
caagacccuuaaaucucccu

SEQ ID NO: 16891 - RNA, 20 nt, Artificial Sequence
  Guide Sequence
caaggaagagcuagccgggg

SEQ ID NO: 16892 - RNA, 20 nt, Artificial Sequence
  Guide Sequence
caaggaauuguuuaccugag

SEQ ID NO: 16893 - RNA, 20 nt, Artificial Sequence
  Guide Sequence
caauuccccaacgaaugguc

SEQ ID NO: 16894 - RNA, 20 nt, Artificial Sequence
  Guide Sequence
cacaaggaauuguuuaccug

SEQ ID NO: 16895 - RNA, 20 nt, Artificial Sequence
  Guide Sequence
cacacaaggaauuguuuacc

SEQ ID NO: 16896 - RNA, 20 nt, Artificial Sequence
  Guide Sequence
cacccagggugcagggcugu

SEQ ID NO: 16897 - RNA, 20 nt, Artificial Sequence
  Guide Sequence
caccccgaccucucuggcug

SEQ ID NO: 16898 - RNA, 20 nt, Artificial Sequence
  Guide Sequence
cacggggccucaccccgacc

SEQ ID NO: 16899 - RNA, 20 nt, Artificial Sequence
  Guide Sequence
cacuaaagaaguuggcccug

SEQ ID NO: 16900 - RNA, 20 nt, Artificial Sequence
  Guide Sequence
cagaaaagcaaacagcacgg

SEQ ID NO: 16901 - RNA, 20 nt, Artificial Sequence
  Guide Sequence
cagaggcaggcaggagggga

SEQ ID NO: 16902 - RNA, 20 nt, Artificial Sequence
  Guide Sequence
cagcacggggccucaccccg

SEQ ID NO: 16903 - RNA, 20 nt, Artificial Sequence
  Guide Sequence
cagccccucaggccccuccu

SEQ ID NO: 16904 - RNA, 20 nt, Artificial Sequence
  Guide Sequence
caggaggggauucugcagaa

SEQ ID NO: 16905 - RNA, 20 nt, Artificial Sequence
  Guide Sequence
caggaggguaauuuagcgac

SEQ ID NO: 16906 - RNA, 20 nt, Artificial Sequence
  Guide Sequence
caggcaggaggggauucugc

SEQ ID NO: 16907 - RNA, 20 nt, Artificial Sequence
  Guide Sequence
caggccccuccuaucagagg

SEQ ID NO: 16908 - RNA, 20 nt, Artificial Sequence
  Guide Sequence
caggcuccaggaggguaauu

SEQ ID NO: 16909 - RNA, 20 nt, Artificial Sequence
  Guide Sequence
cagggcuguuugucaaggaa

SEQ ID NO: 16910 - RNA, 20 nt, Artificial Sequence
  Guide Sequence
cagggugcagggcuguuugu

SEQ ID NO: 16911 - RNA, 20 nt, Artificial Sequence
  Guide Sequence
cagugagaauuagcuguuua

SEQ ID NO: 16912 - RNA, 20 nt, Artificial Sequence
  Guide Sequence
caguuucccuucuuauaaaa

SEQ ID NO: 16913 - RNA, 20 nt, Artificial Sequence
  Guide Sequence
caguuucuggguguuagugu

SEQ ID NO: 16914 - RNA, 20 nt, Artificial Sequence
  Guide Sequence
cauagucugcccagccccuc

SEQ ID NO: 16915 - RNA, 20 nt, Artificial Sequence
  Guide Sequence
caucaauuccccaacgaaug

SEQ ID NO: 16916 - RNA, 20 nt, Artificial Sequence
  Guide Sequence
cauuagccugcucguuaacu

SEQ ID NO: 16917 - RNA, 20 nt, Artificial Sequence
  Guide Sequence
cauugauggaguagccuuga

SEQ ID NO: 16918 - RNA, 20 nt, Artificial Sequence
  Guide Sequence
ccaacgaaugguccugcaua

SEQ ID NO: 16919 - RNA, 20 nt, Artificial Sequence
  Guide Sequence
ccacccagggugcagggcug

SEQ ID NO: 16920 - RNA, 20 nt, Artificial Sequence
  Guide Sequence
ccacuaaagaaguuggcccu

SEQ ID NO: 16921 - RNA, 20 nt, Artificial Sequence
  Guide Sequence
ccagccccucaggccccucc

SEQ ID NO: 16922 - RNA, 20 nt, Artificial Sequence
  Guide Sequence
ccaggaggguaauuuagcga

SEQ ID NO: 16923 - RNA, 20 nt, Artificial Sequence
  Guide Sequence
ccaggcuccaggaggguaau

SEQ ID NO: 16924 - RNA, 20 nt, Artificial Sequence
  Guide Sequence
ccagggugcagggcuguuug

SEQ ID NO: 16925 - RNA, 20 nt, Artificial Sequence
  Guide Sequence
cccaacgaaugguccugcau

SEQ ID NO: 16926 - RNA, 20 nt, Artificial Sequence
  Guide Sequence
cccacccagggugcagggcu

SEQ ID NO: 16927 - RNA, 20 nt, Artificial Sequence
  Guide Sequence
cccagccccucaggccccuc

SEQ ID NO: 16928 - RNA, 20 nt, Artificial Sequence
  Guide Sequence
cccaggcuccaggaggguaa

SEQ ID NO: 16929 - RNA, 20 nt, Artificial Sequence
  Guide Sequence
cccagggugcagggcuguuu

SEQ ID NO: 16930 - RNA, 20 nt, Artificial Sequence
  Guide Sequence
ccccaacgaaugguccugca

SEQ ID NO: 16931 - RNA, 20 nt, Artificial Sequence
  Guide Sequence
ccccgaccucucuggcugac

SEQ ID NO: 16932 - RNA, 20 nt, Artificial Sequence
  Guide Sequence
ccccucaggccccuccuauc

SEQ ID NO: 16933 - RNA, 20 nt, Artificial Sequence
  Guide Sequence
ccccuccuaucagaggcagg

SEQ ID NO: 16934 - RNA, 20 nt, Artificial Sequence
  Guide Sequence
cccgaccucucuggcugacu

SEQ ID NO: 16935 - RNA, 20 nt, Artificial Sequence
  Guide Sequence
cccggucaucaauuccccaa

SEQ ID NO: 16936 - RNA, 20 nt, Artificial Sequence
  Guide Sequence
cccucaggccccuccuauca

SEQ ID NO: 16937 - RNA, 20 nt, Artificial Sequence
  Guide Sequence
cccuccuaucagaggcaggc

SEQ ID NO: 16938 - RNA, 20 nt, Artificial Sequence
  Guide Sequence
cccuggagauggugggagug

SEQ ID NO: 16939 - RNA, 20 nt, Artificial Sequence
  Guide Sequence
cccuuaaaucucccucucac

SEQ ID NO: 16940 - RNA, 20 nt, Artificial Sequence
  Guide Sequence
cccuucuuauaaaacaguga

SEQ ID NO: 16941 - RNA, 20 nt, Artificial Sequence
  Guide Sequence
ccgaccucucuggcugacua

SEQ ID NO: 16942 - RNA, 20 nt, Artificial Sequence
  Guide Sequence
ccggucaucaauuccccaac

SEQ ID NO: 16943 - RNA, 20 nt, Artificial Sequence
  Guide Sequence
ccuaucagaggcaggcagga

SEQ ID NO: 16944 - RNA, 20 nt, Artificial Sequence
  Guide Sequence
ccucaccccgaccucucugg

SEQ ID NO: 16945 - RNA, 20 nt, Artificial Sequence
  Guide Sequence
ccucaggccccuccuaucag

SEQ ID NO: 16946 - RNA, 20 nt, Artificial Sequence
  Guide Sequence
ccuccuaucagaggcaggca

SEQ ID NO: 16947 - RNA, 20 nt, Artificial Sequence
  Guide Sequence
ccucucuggcugacuagccc

SEQ ID NO: 16948 - RNA, 20 nt, Artificial Sequence
  Guide Sequence
ccugagaccuugaucaagac

SEQ ID NO: 16949 - RNA, 20 nt, Artificial Sequence
  Guide Sequence
ccugcauagucugcccagcc

SEQ ID NO: 16950 - RNA, 20 nt, Artificial Sequence
  Guide Sequence
ccuggagauggugggagugc

SEQ ID NO: 16951 - RNA, 20 nt, Artificial Sequence
  Guide Sequence
ccuuaaaucucccucucaca

SEQ ID NO: 16952 - RNA, 20 nt, Artificial Sequence
  Guide Sequence
ccuucuuauaaaacagugag

SEQ ID NO: 16953 - RNA, 20 nt, Artificial Sequence
  Guide Sequence
ccuugaggcccggucaucaa

SEQ ID NO: 16954 - RNA, 20 nt, Artificial Sequence
  Guide Sequence
ccuugaucaagacccuuaaa

SEQ ID NO: 16955 - RNA, 20 nt, Artificial Sequence
  Guide Sequence
cgaaugguccugcauagucu

SEQ ID NO: 16956 - RNA, 20 nt, Artificial Sequence
  Guide Sequence
cgaccucucuggcugacuag

SEQ ID NO: 16957 - RNA, 20 nt, Artificial Sequence
  Guide Sequence
cgacuaucugcuuucauuag

SEQ ID NO: 16958 - RNA, 20 nt, Artificial Sequence
  Guide Sequence
cggggccucaccccgaccuc

SEQ ID NO: 16959 - RNA, 20 nt, Artificial Sequence
  Guide Sequence
cggucaucaauuccccaacg

SEQ ID NO: 16960 - RNA, 20 nt, Artificial Sequence
  Guide Sequence
cuaaagaaguuggcccugga

SEQ ID NO: 16961 - RNA, 20 nt, Artificial Sequence
  Guide Sequence
cuagcccaggcuccaggagg

SEQ ID NO: 16962 - RNA, 20 nt, Artificial Sequence
  Guide Sequence
cuaucagaggcaggcaggag

SEQ ID NO: 16963 - RNA, 20 nt, Artificial Sequence
  Guide Sequence
cuaucugcuuucauuagccu

SEQ ID NO: 16964 - RNA, 20 nt, Artificial Sequence
  Guide Sequence
cucaccccgaccucucuggc

SEQ ID NO: 16965 - RNA, 20 nt, Artificial Sequence
  Guide Sequence
cucaggccccuccuaucaga

SEQ ID NO: 16966 - RNA, 20 nt, Artificial Sequence
  Guide Sequence
cuccaggaggguaauuuagc

SEQ ID NO: 16967 - RNA, 20 nt, Artificial Sequence
  Guide Sequence
cuccuaucagaggcaggcag

SEQ ID NO: 16968 - RNA, 20 nt, Artificial Sequence
  Guide Sequence
cucucuggcugacuagccca

SEQ ID NO: 16969 - RNA, 20 nt, Artificial Sequence
  Guide Sequence
cucuggcugacuagcccagg

SEQ ID NO: 16970 - RNA, 20 nt, Artificial Sequence
  Guide Sequence
cugacuagcccaggcuccag

SEQ ID NO: 16971 - RNA, 20 nt, Artificial Sequence
  Guide Sequence
cugagaccuugaucaagacc

SEQ ID NO: 16972 - RNA, 20 nt, Artificial Sequence
  Guide Sequence
cugcagaaaagcaaacagca

SEQ ID NO: 16973 - RNA, 20 nt, Artificial Sequence
  Guide Sequence
cugcauagucugcccagccc

SEQ ID NO: 16974 - RNA, 20 nt, Artificial Sequence
  Guide Sequence
cugcauugauggaguagccu

SEQ ID NO: 16975 - RNA, 20 nt, Artificial Sequence
  Guide Sequence
cugcccagccccucaggccc

SEQ ID NO: 16976 - RNA, 20 nt, Artificial Sequence
  Guide Sequence
cugcuuucauuagccugcuc

SEQ ID NO: 16977 - RNA, 20 nt, Artificial Sequence
  Guide Sequence
cuggagauggugggagugcc

SEQ ID NO: 16978 - RNA, 20 nt, Artificial Sequence
  Guide Sequence
cuggcugacuagcccaggcu

SEQ ID NO: 16979 - RNA, 20 nt, Artificial Sequence
  Guide Sequence
cuggguguuaguguguguuu

SEQ ID NO: 16980 - RNA, 20 nt, Artificial Sequence
  Guide Sequence
cugucaguuucuggguguua

SEQ ID NO: 16981 - RNA, 20 nt, Artificial Sequence
  Guide Sequence
cuguuuacacacaaggaauu

SEQ ID NO: 16982 - RNA, 20 nt, Artificial Sequence
  Guide Sequence
cuguuugucaaggaagagcu

SEQ ID NO: 16983 - RNA, 20 nt, Artificial Sequence
  Guide Sequence
cuuaaaucucccucucacac

SEQ ID NO: 16984 - RNA, 20 nt, Artificial Sequence
  Guide Sequence
cuucuuauaaaacagugaga

SEQ ID NO: 16985 - RNA, 20 nt, Artificial Sequence
  Guide Sequence
cuugaggcccggucaucaau

SEQ ID NO: 16986 - RNA, 20 nt, Artificial Sequence
  Guide Sequence
cuugaucaagacccuuaaau

SEQ ID NO: 16987 - RNA, 20 nt, Artificial Sequence
  Guide Sequence
cuuucauuagccugcucguu

SEQ ID NO: 16988 - RNA, 20 nt, Artificial Sequence
  Guide Sequence
gaaaagcaaacagcacgggg

SEQ ID NO: 16989 - RNA, 20 nt, Artificial Sequence
  Guide Sequence
gaaguuggcccuggagaugg

SEQ ID NO: 16990 - RNA, 20 nt, Artificial Sequence
  Guide Sequence
gaaugguccugcauagucug

SEQ ID NO: 16991 - RNA, 20 nt, Artificial Sequence
  Guide Sequence
gaauuagcuguuuacacaca

SEQ ID NO: 16992 - RNA, 20 nt, Artificial Sequence
  Guide Sequence
gaauuguuuaccugagaccu

SEQ ID NO: 16993 - RNA, 20 nt, Artificial Sequence
  Guide Sequence
gacccuuaaaucucccucuc

SEQ ID NO: 16994 - RNA, 20 nt, Artificial Sequence
  Guide Sequence
gaccucucuggcugacuagc

SEQ ID NO: 16995 - RNA, 20 nt, Artificial Sequence
  Guide Sequence
gaccuugaucaagacccuua

SEQ ID NO: 16996 - RNA, 20 nt, Artificial Sequence
  Guide Sequence
gacuagcccaggcuccagga

SEQ ID NO: 16997 - RNA, 20 nt, Artificial Sequence
  Guide Sequence
gacuaucugcuuucauuagc

SEQ ID NO: 16998 - RNA, 20 nt, Artificial Sequence
  Guide Sequence
gagaauuagcuguuuacaca

SEQ ID NO: 16999 - RNA, 20 nt, Artificial Sequence
  Guide Sequence
gagaccuugaucaagacccu

SEQ ID NO: 17000 - RNA, 20 nt, Artificial Sequence
  Guide Sequence
gagagggggcugucaguuuc

SEQ ID NO: 17001 - RNA, 20 nt, Artificial Sequence
  Guide Sequence
gagauggugggagugcccac

SEQ ID NO: 17002 - RNA, 20 nt, Artificial Sequence
  Guide Sequence
gaggagagggggcugucagu

SEQ ID NO: 17003 - RNA, 20 nt, Artificial Sequence
  Guide Sequence
gaggcaggcaggaggggauu

SEQ ID NO: 17004 - RNA, 20 nt, Artificial Sequence
  Guide Sequence
gaggcccggucaucaauucc

SEQ ID NO: 17005 - RNA, 20 nt, Artificial Sequence
  Guide Sequence
gaggggauucugcagaaaag

SEQ ID NO: 17006 - RNA, 20 nt, Artificial Sequence
  Guide Sequence
gagggggcugucaguuucug

SEQ ID NO: 17007 - RNA, 20 nt, Artificial Sequence
  Guide Sequence
gaggguaauuuagcgacuau

SEQ ID NO: 17008 - RNA, 20 nt, Artificial Sequence
  Guide Sequence
gaguagccuugaggcccggu

SEQ ID NO: 17009 - RNA, 20 nt, Artificial Sequence
  Guide Sequence
gagugcccacccagggugca

SEQ ID NO: 17010 - RNA, 20 nt, Artificial Sequence
  Guide Sequence
gauaguaaccacuaaagaag

SEQ ID NO: 17011 - RNA, 20 nt, Artificial Sequence
  Guide Sequence
gaucaagacccuuaaaucuc

SEQ ID NO: 17012 - RNA, 20 nt, Artificial Sequence
  Guide Sequence
gauggaguagccuugaggcc

SEQ ID NO: 17013 - RNA, 20 nt, Artificial Sequence
  Guide Sequence
gauggugggagugcccaccc

SEQ ID NO: 17014 - RNA, 20 nt, Artificial Sequence
  Guide Sequence
gauucugcagaaaagcaaac

SEQ ID NO: 17015 - RNA, 20 nt, Artificial Sequence
  Guide Sequence
gcaaacagcacggggccuca

SEQ ID NO: 17016 - RNA, 20 nt, Artificial Sequence
  Guide Sequence
gcacggggccucaccccgac

SEQ ID NO: 17017 - RNA, 20 nt, Artificial Sequence
  Guide Sequence
gcagaaaagcaaacagcacg

SEQ ID NO: 17018 - RNA, 20 nt, Artificial Sequence
  Guide Sequence
gcaggaggggauucugcaga

SEQ ID NO: 17019 - RNA, 20 nt, Artificial Sequence
  Guide Sequence
gcaggcaggaggggauucug

SEQ ID NO: 17020 - RNA, 20 nt, Artificial Sequence
  Guide Sequence
gcagggcuguuugucaagga

SEQ ID NO: 17021 - RNA, 20 nt, Artificial Sequence
  Guide Sequence
gcauagucugcccagccccu

SEQ ID NO: 17022 - RNA, 20 nt, Artificial Sequence
  Guide Sequence
gcauugauggaguagccuug

SEQ ID NO: 17023 - RNA, 20 nt, Artificial Sequence
  Guide Sequence
gcccacccagggugcagggc

SEQ ID NO: 17024 - RNA, 20 nt, Artificial Sequence
  Guide Sequence
gcccagccccucaggccccu

SEQ ID NO: 17025 - RNA, 20 nt, Artificial Sequence
  Guide Sequence
gcccaggcuccaggagggua

SEQ ID NO: 17026 - RNA, 20 nt, Artificial Sequence
  Guide Sequence
gccccucaggccccuccuau

SEQ ID NO: 17027 - RNA, 20 nt, Artificial Sequence
  Guide Sequence
gccccuccuaucagaggcag

SEQ ID NO: 17028 - RNA, 20 nt, Artificial Sequence
  Guide Sequence
gcccggucaucaauucccca

SEQ ID NO: 17029 - RNA, 20 nt, Artificial Sequence
  Guide Sequence
gcccuggagauggugggagu

SEQ ID NO: 17030 - RNA, 20 nt, Artificial Sequence
  Guide Sequence
gccucaccccgaccucucug

SEQ ID NO: 17031 - RNA, 20 nt, Artificial Sequence
  Guide Sequence
gccuugaggcccggucauca

SEQ ID NO: 17032 - RNA, 20 nt, Artificial Sequence
  Guide Sequence
gcgacuaucugcuuucauua

SEQ ID NO: 17033 - RNA, 20 nt, Artificial Sequence
  Guide Sequence
gcuccaggaggguaauuuag

SEQ ID NO: 17034 - RNA, 20 nt, Artificial Sequence
  Guide Sequence
gcugacuagcccaggcucca

SEQ ID NO: 17035 - RNA, 20 nt, Artificial Sequence
  Guide Sequence
gcugcauugauggaguagcc

SEQ ID NO: 17036 - RNA, 20 nt, Artificial Sequence
  Guide Sequence
gcugucaguuucuggguguu

SEQ ID NO: 17037 - RNA, 20 nt, Artificial Sequence
  Guide Sequence
gcuguuuacacacaaggaau

SEQ ID NO: 17038 - RNA, 20 nt, Artificial Sequence
  Guide Sequence
gcuguuugucaaggaagagc

SEQ ID NO: 17039 - RNA, 20 nt, Artificial Sequence
  Guide Sequence
gcuuucauuagccugcucgu

SEQ ID NO: 17040 - RNA, 20 nt, Artificial Sequence
  Guide Sequence
ggaauuguuuaccugagacc

SEQ ID NO: 17041 - RNA, 20 nt, Artificial Sequence
  Guide Sequence
ggagagggggcugucaguuu

SEQ ID NO: 17042 - RNA, 20 nt, Artificial Sequence
  Guide Sequence
ggagauggugggagugccca

SEQ ID NO: 17043 - RNA, 20 nt, Artificial Sequence
  Guide Sequence
ggaggggauucugcagaaaa

SEQ ID NO: 17044 - RNA, 20 nt, Artificial Sequence
  Guide Sequence
ggaggguaauuuagcgacua

SEQ ID NO: 17045 - RNA, 20 nt, Artificial Sequence
  Guide Sequence
ggaguagccuugaggcccgg

SEQ ID NO: 17046 - RNA, 20 nt, Artificial Sequence
  Guide Sequence
ggagugcccacccagggugc

SEQ ID NO: 17047 - RNA, 20 nt, Artificial Sequence
  Guide Sequence
ggauaguaaccacuaaagaa

SEQ ID NO: 17048 - RNA, 20 nt, Artificial Sequence
  Guide Sequence
ggauucugcagaaaagcaaa

SEQ ID NO: 17049 - RNA, 20 nt, Artificial Sequence
  Guide Sequence
ggcaggaggggauucugcag

SEQ ID NO: 17050 - RNA, 20 nt, Artificial Sequence
  Guide Sequence
ggcaggcaggaggggauucu

SEQ ID NO: 17051 - RNA, 20 nt, Artificial Sequence
  Guide Sequence
ggccccuccuaucagaggca

SEQ ID NO: 17052 - RNA, 20 nt, Artificial Sequence
  Guide Sequence
ggcccggucaucaauucccc

SEQ ID NO: 17053 - RNA, 20 nt, Artificial Sequence
  Guide Sequence
ggcccuggagauggugggag

SEQ ID NO: 17054 - RNA, 20 nt, Artificial Sequence
  Guide Sequence
ggccucaccccgaccucucu

SEQ ID NO: 17055 - RNA, 20 nt, Artificial Sequence
  Guide Sequence
ggcuccaggaggguaauuua

SEQ ID NO: 17056 - RNA, 20 nt, Artificial Sequence
  Guide Sequence
ggcugacuagcccaggcucc

SEQ ID NO: 17057 - RNA, 20 nt, Artificial Sequence
  Guide Sequence
ggcugcauugauggaguagc

SEQ ID NO: 17058 - RNA, 20 nt, Artificial Sequence
  Guide Sequence
ggcugucaguuucugggugu

SEQ ID NO: 17059 - RNA, 20 nt, Artificial Sequence
  Guide Sequence
ggcuguuugucaaggaagag

SEQ ID NO: 17060 - RNA, 20 nt, Artificial Sequence
  Guide Sequence
gggagugcccacccagggug

SEQ ID NO: 17061 - RNA, 20 nt, Artificial Sequence
  Guide Sequence
gggauaguaaccacuaaaga

SEQ ID NO: 17062 - RNA, 20 nt, Artificial Sequence
  Guide Sequence
gggauucugcagaaaagcaa

SEQ ID NO: 17063 - RNA, 20 nt, Artificial Sequence
  Guide Sequence
gggccucaccccgaccucuc

SEQ ID NO: 17064 - RNA, 20 nt, Artificial Sequence
  Guide Sequence
gggcugcauugauggaguag

SEQ ID NO: 17065 - RNA, 20 nt, Artificial Sequence
  Guide Sequence
gggcugucaguuucugggug

SEQ ID NO: 17066 - RNA, 20 nt, Artificial Sequence
  Guide Sequence
gggcuguuugucaaggaaga

SEQ ID NO: 17067 - RNA, 20 nt, Artificial Sequence
  Guide Sequence
ggggauucugcagaaaagca

SEQ ID NO: 17068 - RNA, 20 nt, Artificial Sequence
  Guide Sequence
ggggccucaccccgaccucu

SEQ ID NO: 17069 - RNA, 20 nt, Artificial Sequence
  Guide Sequence
ggggcugcauugauggagua

SEQ ID NO: 17070 - RNA, 20 nt, Artificial Sequence
  Guide Sequence
ggggcugucaguuucugggu

SEQ ID NO: 17071 - RNA, 20 nt, Artificial Sequence
  Guide Sequence
gggggcugcauugauggagu

SEQ ID NO: 17072 - RNA, 20 nt, Artificial Sequence
  Guide Sequence
gggggcugucaguuucuggg

SEQ ID NO: 17073 - RNA, 20 nt, Artificial Sequence
  Guide Sequence
ggggggugggugaggagagg

SEQ ID NO: 17074 - RNA, 20 nt, Artificial Sequence
  Guide Sequence
gggggugggugaggagaggg

SEQ ID NO: 17075 - RNA, 20 nt, Artificial Sequence
  Guide Sequence
ggggugggugaggagagggg

SEQ ID NO: 17076 - RNA, 20 nt, Artificial Sequence
  Guide Sequence
ggguaauuuagcgacuaucu

SEQ ID NO: 17077 - RNA, 20 nt, Artificial Sequence
  Guide Sequence
gggugaggagagggggcugu

SEQ ID NO: 17078 - RNA, 20 nt, Artificial Sequence
  Guide Sequence
gggugcagggcuguuuguca

SEQ ID NO: 17079 - RNA, 20 nt, Artificial Sequence
  Guide Sequence
gggugggugaggagaggggg

SEQ ID NO: 17080 - RNA, 20 nt, Artificial Sequence
  Guide Sequence
ggguguuaguguguguuuuc

SEQ ID NO: 17081 - RNA, 20 nt, Artificial Sequence
  Guide Sequence
gguaauuuagcgacuaucug

SEQ ID NO: 17082 - RNA, 20 nt, Artificial Sequence
  Guide Sequence
ggucaucaauuccccaacga

SEQ ID NO: 17083 - RNA, 20 nt, Artificial Sequence
  Guide Sequence
gguccugcauagucugccca

SEQ ID NO: 17084 - RNA, 20 nt, Artificial Sequence
  Guide Sequence
ggugaggagagggggcuguc

SEQ ID NO: 17085 - RNA, 20 nt, Artificial Sequence
  Guide Sequence
ggugcagggcuguuugucaa

SEQ ID NO: 17086 - RNA, 20 nt, Artificial Sequence
  Guide Sequence
ggugggagugcccacccagg

SEQ ID NO: 17087 - RNA, 20 nt, Artificial Sequence
  Guide Sequence
ggugggugaggagagggggc

SEQ ID NO: 17088 - RNA, 20 nt, Artificial Sequence
  Guide Sequence
gguguuaguguguguuuuca

SEQ ID NO: 17089 - RNA, 20 nt, Artificial Sequence
  Guide Sequence
guaaccacuaaagaaguugg

SEQ ID NO: 17090 - RNA, 20 nt, Artificial Sequence
  Guide Sequence
guaauuuagcgacuaucugc

SEQ ID NO: 17091 - RNA, 20 nt, Artificial Sequence
  Guide Sequence
guagccuugaggcccgguca

SEQ ID NO: 17092 - RNA, 20 nt, Artificial Sequence
  Guide Sequence
gucaaggaagagcuagccgg

SEQ ID NO: 17093 - RNA, 20 nt, Artificial Sequence
  Guide Sequence
gucaguuucuggguguuagu

SEQ ID NO: 17094 - RNA, 20 nt, Artificial Sequence
  Guide Sequence
gucaucaauuccccaacgaa

SEQ ID NO: 17095 - RNA, 20 nt, Artificial Sequence
  Guide Sequence
guccugcauagucugcccag

SEQ ID NO: 17096 - RNA, 20 nt, Artificial Sequence
  Guide Sequence
gucugcccagccccucaggc

SEQ ID NO: 17097 - RNA, 20 nt, Artificial Sequence
  Guide Sequence
gugagaauuagcuguuuaca

SEQ ID NO: 17098 - RNA, 20 nt, Artificial Sequence
  Guide Sequence
gugaggagagggggcuguca

SEQ ID NO: 17099 - RNA, 20 nt, Artificial Sequence
  Guide Sequence
gugcagggcuguuugucaag

SEQ ID NO: 17100 - RNA, 20 nt, Artificial Sequence
  Guide Sequence
gugcccacccagggugcagg

SEQ ID NO: 17101 - RNA, 20 nt, Artificial Sequence
  Guide Sequence
gugggagugcccacccaggg

SEQ ID NO: 17102 - RNA, 20 nt, Artificial Sequence
  Guide Sequence
gugggugaggagagggggcu

SEQ ID NO: 17103 - RNA, 20 nt, Artificial Sequence
  Guide Sequence
guguguguuuucaguuuccc

SEQ ID NO: 17104 - RNA, 20 nt, Artificial Sequence
  Guide Sequence
guguguuuucaguuucccuu

SEQ ID NO: 17105 - RNA, 20 nt, Artificial Sequence
  Guide Sequence
guguuaguguguguuuucag

SEQ ID NO: 17106 - RNA, 20 nt, Artificial Sequence
  Guide Sequence
guguuuucaguuucccuucu

SEQ ID NO: 17107 - RNA, 20 nt, Artificial Sequence
  Guide Sequence
guuaguguguguuuucaguu

SEQ ID NO: 17108 - RNA, 20 nt, Artificial Sequence
  Guide Sequence
guuggcccuggagauggugg

SEQ ID NO: 17109 - RNA, 20 nt, Artificial Sequence
  Guide Sequence
guuuacacacaaggaauugu

SEQ ID NO: 17110 - RNA, 20 nt, Artificial Sequence
  Guide Sequence
guuuaccugagaccuugauc

SEQ ID NO: 17111 - RNA, 20 nt, Artificial Sequence
  Guide Sequence
guuucccuucuuauaaaaca

SEQ ID NO: 17112 - RNA, 20 nt, Artificial Sequence
  Guide Sequence
guuucuggguguuagugugu

SEQ ID NO: 17113 - RNA, 20 nt, Artificial Sequence
  Guide Sequence
guuugucaaggaagagcuag

SEQ ID NO: 17114 - RNA, 20 nt, Artificial Sequence
  Guide Sequence
guuuucaguuucccuucuua

SEQ ID NO: 17115 - RNA, 20 nt, Artificial Sequence
  Guide Sequence
uaaaacagugagaauuagcu

SEQ ID NO: 17116 - RNA, 20 nt, Artificial Sequence
  Guide Sequence
uaaagaaguuggcccuggag

SEQ ID NO: 17117 - RNA, 20 nt, Artificial Sequence
  Guide Sequence
uaaaucucccucucacacua

SEQ ID NO: 17118 - RNA, 20 nt, Artificial Sequence
  Guide Sequence
uaaccacuaaagaaguuggc

SEQ ID NO: 17119 - RNA, 20 nt, Artificial Sequence
  Guide Sequence
uaauuuagcgacuaucugcu

SEQ ID NO: 17120 - RNA, 20 nt, Artificial Sequence
  Guide Sequence
uacacacaaggaauuguuua

SEQ ID NO: 17121 - RNA, 20 nt, Artificial Sequence
  Guide Sequence
uaccugagaccuugaucaag

SEQ ID NO: 17122 - RNA, 20 nt, Artificial Sequence
  Guide Sequence
uagcccaggcuccaggaggg

SEQ ID NO: 17123 - RNA, 20 nt, Artificial Sequence
  Guide Sequence
uagccuugaggcccggucau

SEQ ID NO: 17124 - RNA, 20 nt, Artificial Sequence
  Guide Sequence
uagcgacuaucugcuuucau

SEQ ID NO: 17125 - RNA, 20 nt, Artificial Sequence
  Guide Sequence
uagcuguuuacacacaagga

SEQ ID NO: 17126 - RNA, 20 nt, Artificial Sequence
  Guide Sequence
uaguaaccacuaaagaaguu

SEQ ID NO: 17127 - RNA, 20 nt, Artificial Sequence
  Guide Sequence
uagucugcccagccccucag

SEQ ID NO: 17128 - RNA, 20 nt, Artificial Sequence
  Guide Sequence
uaguguguguuuucaguuuc

SEQ ID NO: 17129 - RNA, 20 nt, Artificial Sequence
  Guide Sequence
uaucagaggcaggcaggagg

SEQ ID NO: 17130 - RNA, 20 nt, Artificial Sequence
  Guide Sequence
uaucugcuuucauuagccug

SEQ ID NO: 17131 - RNA, 20 nt, Artificial Sequence
  Guide Sequence
ucaagacccuuaaaucuccc

SEQ ID NO: 17132 - RNA, 20 nt, Artificial Sequence
  Guide Sequence
ucaaggaagagcuagccggg

SEQ ID NO: 17133 - RNA, 20 nt, Artificial Sequence
  Guide Sequence
ucaauuccccaacgaauggu

SEQ ID NO: 17134 - RNA, 20 nt, Artificial Sequence
  Guide Sequence
ucaccccgaccucucuggcu

SEQ ID NO: 17135 - RNA, 20 nt, Artificial Sequence
  Guide Sequence
ucagaggcaggcaggagggg

SEQ ID NO: 17136 - RNA, 20 nt, Artificial Sequence
  Guide Sequence
ucaggccccuccuaucagag

SEQ ID NO: 17137 - RNA, 20 nt, Artificial Sequence
  Guide Sequence
ucaguuucccuucuuauaaa

SEQ ID NO: 17138 - RNA, 20 nt, Artificial Sequence
  Guide Sequence
ucaguuucuggguguuagug

SEQ ID NO: 17139 - RNA, 20 nt, Artificial Sequence
  Guide Sequence
ucaucaauuccccaacgaau

SEQ ID NO: 17140 - RNA, 20 nt, Artificial Sequence
  Guide Sequence
ucauuagccugcucguuaac

SEQ ID NO: 17141 - RNA, 20 nt, Artificial Sequence
  Guide Sequence
uccaggaggguaauuuagcg

SEQ ID NO: 17142 - RNA, 20 nt, Artificial Sequence
  Guide Sequence
uccccaacgaaugguccugc

SEQ ID NO: 17143 - RNA, 20 nt, Artificial Sequence
  Guide Sequence
ucccuucuuauaaaacagug

SEQ ID NO: 17144 - RNA, 20 nt, Artificial Sequence
  Guide Sequence
uccuaucagaggcaggcagg

SEQ ID NO: 17145 - RNA, 20 nt, Artificial Sequence
  Guide Sequence
uccugcauagucugcccagc

SEQ ID NO: 17146 - RNA, 20 nt, Artificial Sequence
  Guide Sequence
ucucuggcugacuagcccag

SEQ ID NO: 17147 - RNA, 20 nt, Artificial Sequence
  Guide Sequence
ucugcagaaaagcaaacagc

SEQ ID NO: 17148 - RNA, 20 nt, Artificial Sequence
  Guide Sequence
ucugcccagccccucaggcc

SEQ ID NO: 17149 - RNA, 20 nt, Artificial Sequence
  Guide Sequence
ucugcuuucauuagccugcu

SEQ ID NO: 17150 - RNA, 20 nt, Artificial Sequence
  Guide Sequence
ucuggcugacuagcccaggc

SEQ ID NO: 17151 - RNA, 20 nt, Artificial Sequence
  Guide Sequence
ucuggguguuaguguguguu

SEQ ID NO: 17152 - RNA, 20 nt, Artificial Sequence
  Guide Sequence
ugacuagcccaggcuccagg

SEQ ID NO: 17153 - RNA, 20 nt, Artificial Sequence
  Guide Sequence
ugagaauuagcuguuuacac

SEQ ID NO: 17154 - RNA, 20 nt, Artificial Sequence
  Guide Sequence
ugagaccuugaucaagaccc

SEQ ID NO: 17155 - RNA, 20 nt, Artificial Sequence
  Guide Sequence
ugaggagagggggcugucag

SEQ ID NO: 17156 - RNA, 20 nt, Artificial Sequence
  Guide Sequence
ugaggcccggucaucaauuc

SEQ ID NO: 17157 - RNA, 20 nt, Artificial Sequence
  Guide Sequence
ugaucaagacccuuaaaucu

SEQ ID NO: 17158 - RNA, 20 nt, Artificial Sequence
  Guide Sequence
ugauggaguagccuugaggc

SEQ ID NO: 17159 - RNA, 20 nt, Artificial Sequence
  Guide Sequence
ugcagaaaagcaaacagcac

SEQ ID NO: 17160 - RNA, 20 nt, Artificial Sequence
  Guide Sequence
ugcagggcuguuugucaagg

SEQ ID NO: 17161 - RNA, 20 nt, Artificial Sequence
  Guide Sequence
ugcauagucugcccagcccc

SEQ ID NO: 17162 - RNA, 20 nt, Artificial Sequence
  Guide Sequence
ugcauugauggaguagccuu

SEQ ID NO: 17163 - RNA, 20 nt, Artificial Sequence
  Guide Sequence
ugcccacccagggugcaggg

SEQ ID NO: 17164 - RNA, 20 nt, Artificial Sequence
  Guide Sequence
ugcccagccccucaggcccc

SEQ ID NO: 17165 - RNA, 20 nt, Artificial Sequence
  Guide Sequence
ugcuuucauuagccugcucg

SEQ ID NO: 17166 - RNA, 20 nt, Artificial Sequence
  Guide Sequence
uggagauggugggagugccc

SEQ ID NO: 17167 - RNA, 20 nt, Artificial Sequence
  Guide Sequence
uggaguagccuugaggcccg

SEQ ID NO: 17168 - RNA, 20 nt, Artificial Sequence
  Guide Sequence
uggcccuggagaugguggga

SEQ ID NO: 17169 - RNA, 20 nt, Artificial Sequence
  Guide Sequence
uggcugacuagcccaggcuc

SEQ ID NO: 17170 - RNA, 20 nt, Artificial Sequence
  Guide Sequence
ugggagugcccacccagggu

SEQ ID NO: 17171 - RNA, 20 nt, Artificial Sequence
  Guide Sequence
ugggugaggagagggggcug

SEQ ID NO: 17172 - RNA, 20 nt, Artificial Sequence
  Guide Sequence
uggguguuaguguguguuuu

SEQ ID NO: 17173 - RNA, 20 nt, Artificial Sequence
  Guide Sequence
ugguccugcauagucugccc

SEQ ID NO: 17174 - RNA, 20 nt, Artificial Sequence
  Guide Sequence
uggugggagugcccacccag

SEQ ID NO: 17175 - RNA, 20 nt, Artificial Sequence
  Guide Sequence
ugucaaggaagagcuagccg

SEQ ID NO: 17176 - RNA, 20 nt, Artificial Sequence
  Guide Sequence
ugucaguuucuggguguuag

SEQ ID NO: 17177 - RNA, 20 nt, Artificial Sequence
  Guide Sequence
uguguguuuucaguuucccu

SEQ ID NO: 17178 - RNA, 20 nt, Artificial Sequence
  Guide Sequence
uguguuuucaguuucccuuc

SEQ ID NO: 17179 - RNA, 20 nt, Artificial Sequence
  Guide Sequence
uguuaguguguguuuucagu

SEQ ID NO: 17180 - RNA, 20 nt, Artificial Sequence
  Guide Sequence
uguuuacacacaaggaauug

SEQ ID NO: 17181 - RNA, 20 nt, Artificial Sequence
  Guide Sequence
uguuuaccugagaccuugau

SEQ ID NO: 17182 - RNA, 20 nt, Artificial Sequence
  Guide Sequence
uguuugucaaggaagagcua

SEQ ID NO: 17183 - RNA, 20 nt, Artificial Sequence
  Guide Sequence
uguuuucaguuucccuucuu

SEQ ID NO: 17184 - RNA, 20 nt, Artificial Sequence
  Guide Sequence
uuaaaucucccucucacacu

SEQ ID NO: 17185 - RNA, 20 nt, Artificial Sequence
  Guide Sequence
uuacacacaaggaauuguuu

SEQ ID NO: 17186 - RNA, 20 nt, Artificial Sequence
  Guide Sequence
uuaccugagaccuugaucaa

SEQ ID NO: 17187 - RNA, 20 nt, Artificial Sequence
  Guide Sequence
uuagccugcucguuaacuuu

SEQ ID NO: 17188 - RNA, 20 nt, Artificial Sequence
  Guide Sequence
uuagcgacuaucugcuuuca

SEQ ID NO: 17189 - RNA, 20 nt, Artificial Sequence
  Guide Sequence
uuagcuguuuacacacaagg

SEQ ID NO: 17190 - RNA, 20 nt, Artificial Sequence
  Guide Sequence
uuaguguguguuuucaguuu

SEQ ID NO: 17191 - RNA, 20 nt, Artificial Sequence
  Guide Sequence
uucaguuucccuucuuauaa

SEQ ID NO: 17192 - RNA, 20 nt, Artificial Sequence
  Guide Sequence
uucauuagccugcucguuaa

SEQ ID NO: 17193 - RNA, 20 nt, Artificial Sequence
  Guide Sequence
uuccccaacgaaugguccug

SEQ ID NO: 17194 - RNA, 20 nt, Artificial Sequence
  Guide Sequence
uucccuucuuauaaaacagu

SEQ ID NO: 17195 - RNA, 20 nt, Artificial Sequence
  Guide Sequence
uucugcagaaaagcaaacag

SEQ ID NO: 17196 - RNA, 20 nt, Artificial Sequence
  Guide Sequence
uucuggguguuagugugugu

SEQ ID NO: 17197 - RNA, 20 nt, Artificial Sequence
  Guide Sequence
uugaggcccggucaucaauu

SEQ ID NO: 17198 - RNA, 20 nt, Artificial Sequence
  Guide Sequence
uugaucaagacccuuaaauc

SEQ ID NO: 17199 - RNA, 20 nt, Artificial Sequence
  Guide Sequence
uugauggaguagccuugagg

SEQ ID NO: 17200 - RNA, 20 nt, Artificial Sequence
  Guide Sequence
uuggcccuggagaugguggg

SEQ ID NO: 17201 - RNA, 20 nt, Artificial Sequence
  Guide Sequence
uugucaaggaagagcuagcc

SEQ ID NO: 17202 - RNA, 20 nt, Artificial Sequence
  Guide Sequence
uuguuuaccugagaccuuga

SEQ ID NO: 17203 - RNA, 20 nt, Artificial Sequence
  Guide Sequence
uuuacacacaaggaauuguu

SEQ ID NO: 17204 - RNA, 20 nt, Artificial Sequence
  Guide Sequence
uuuaccugagaccuugauca

SEQ ID NO: 17205 - RNA, 20 nt, Artificial Sequence
  Guide Sequence
uuuagcgacuaucugcuuuc

SEQ ID NO: 17206 - RNA, 20 nt, Artificial Sequence
  Guide Sequence
uuucaguuucccuucuuaua

SEQ ID NO: 17207 - RNA, 20 nt, Artificial Sequence
  Guide Sequence
uuucauuagccugcucguua

SEQ ID NO: 17208 - RNA, 20 nt, Artificial Sequence
  Guide Sequence
uuucccuucuuauaaaacag

SEQ ID NO: 17209 - RNA, 20 nt, Artificial Sequence
  Guide Sequence
uuucuggguguuagugugug

SEQ ID NO: 17210 - RNA, 20 nt, Artificial Sequence
  Guide Sequence
uuugucaaggaagagcuagc

SEQ ID NO: 17211 - RNA, 20 nt, Artificial Sequence
  Guide Sequence
uuuucaguuucccuucuuau

SEQ ID NO: 17212 - RNA, 21 nt, Artificial Sequence
  Guide Sequence
aaaacagugagaauuagcugu

SEQ ID NO: 17213 - RNA, 21 nt, Artificial Sequence
  Guide Sequence
aaaagcaaacagcacggggcc

SEQ ID NO: 17214 - RNA, 21 nt, Artificial Sequence
  Guide Sequence
aaacagcacggggccucaccc

SEQ ID NO: 17215 - RNA, 21 nt, Artificial Sequence
  Guide Sequence
aaacagugagaauuagcuguu

SEQ ID NO: 17216 - RNA, 21 nt, Artificial Sequence
  Guide Sequence
aaagaaguuggcccuggagau

SEQ ID NO: 17217 - RNA, 21 nt, Artificial Sequence
  Guide Sequence
aaagcaaacagcacggggccu

SEQ ID NO: 17218 - RNA, 21 nt, Artificial Sequence
  Guide Sequence
aacagcacggggccucacccc

SEQ ID NO: 17219 - RNA, 21 nt, Artificial Sequence
  Guide Sequence
aacagugagaauuagcuguuu

SEQ ID NO: 17220 - RNA, 21 nt, Artificial Sequence
  Guide Sequence
aaccacuaaagaaguuggccc

SEQ ID NO: 17221 - RNA, 21 nt, Artificial Sequence
  Guide Sequence
aacgaaugguccugcauaguc

SEQ ID NO: 17222 - RNA, 21 nt, Artificial Sequence
  Guide Sequence
aagaaguuggcccuggagaug

SEQ ID NO: 17223 - RNA, 21 nt, Artificial Sequence
  Guide Sequence
aagacccuuaaaucucccucu

SEQ ID NO: 17224 - RNA, 21 nt, Artificial Sequence
  Guide Sequence
aagcaaacagcacggggccuc

SEQ ID NO: 17225 - RNA, 21 nt, Artificial Sequence
  Guide Sequence
aaggaagagcuagccgggggg

SEQ ID NO: 17226 - RNA, 21 nt, Artificial Sequence
  Guide Sequence
aaggaauuguuuaccugagac

SEQ ID NO: 17227 - RNA, 21 nt, Artificial Sequence
  Guide Sequence
aaguuggcccuggagauggug

SEQ ID NO: 17228 - RNA, 21 nt, Artificial Sequence
  Guide Sequence
aaugguccugcauagucugcc

SEQ ID NO: 17229 - RNA, 21 nt, Artificial Sequence
  Guide Sequence
aauuagcuguuuacacacaag

SEQ ID NO: 17230 - RNA, 21 nt, Artificial Sequence
  Guide Sequence
aauuccccaacgaaugguccu

SEQ ID NO: 17231 - RNA, 21 nt, Artificial Sequence
  Guide Sequence
aauuguuuaccugagaccuug

SEQ ID NO: 17232 - RNA, 21 nt, Artificial Sequence
  Guide Sequence
aauuuagcgacuaucugcuuu

SEQ ID NO: 17233 - RNA, 21 nt, Artificial Sequence
  Guide Sequence
acaaggaauuguuuaccugag

SEQ ID NO: 17234 - RNA, 21 nt, Artificial Sequence
  Guide Sequence
acacaaggaauuguuuaccug

SEQ ID NO: 17235 - RNA, 21 nt, Artificial Sequence
  Guide Sequence
acacacaaggaauuguuuacc

SEQ ID NO: 17236 - RNA, 21 nt, Artificial Sequence
  Guide Sequence
acagcacggggccucaccccg

SEQ ID NO: 17237 - RNA, 21 nt, Artificial Sequence
  Guide Sequence
acagugagaauuagcuguuua

SEQ ID NO: 17238 - RNA, 21 nt, Artificial Sequence
  Guide Sequence
accacuaaagaaguuggcccu

SEQ ID NO: 17239 - RNA, 21 nt, Artificial Sequence
  Guide Sequence
acccagggugcagggcuguuu

SEQ ID NO: 17240 - RNA, 21 nt, Artificial Sequence
  Guide Sequence
accccgaccucucuggcugac

SEQ ID NO: 17241 - RNA, 21 nt, Artificial Sequence
  Guide Sequence
acccuuaaaucucccucucac

SEQ ID NO: 17242 - RNA, 21 nt, Artificial Sequence
  Guide Sequence
accucucuggcugacuagccc

SEQ ID NO: 17243 - RNA, 21 nt, Artificial Sequence
  Guide Sequence
accugagaccuugaucaagac

SEQ ID NO: 17244 - RNA, 21 nt, Artificial Sequence
  Guide Sequence
accuugaucaagacccuuaaa

SEQ ID NO: 17245 - RNA, 21 nt, Artificial Sequence
  Guide Sequence
acgaaugguccugcauagucu

SEQ ID NO: 17246 - RNA, 21 nt, Artificial Sequence
  Guide Sequence
acggggccucaccccgaccuc

SEQ ID NO: 17247 - RNA, 21 nt, Artificial Sequence
  Guide Sequence
acuaaagaaguuggcccugga

SEQ ID NO: 17248 - RNA, 21 nt, Artificial Sequence
  Guide Sequence
acuagcccaggcuccaggagg

SEQ ID NO: 17249 - RNA, 21 nt, Artificial Sequence
  Guide Sequence
acuaucugcuuucauuagccu

SEQ ID NO: 17250 - RNA, 21 nt, Artificial Sequence
  Guide Sequence
agaaaagcaaacagcacgggg

SEQ ID NO: 17251 - RNA, 21 nt, Artificial Sequence
  Guide Sequence
agaaguuggcccuggagaugg

SEQ ID NO: 17252 - RNA, 21 nt, Artificial Sequence
  Guide Sequence
agaauuagcuguuuacacaca

SEQ ID NO: 17253 - RNA, 21 nt, Artificial Sequence
  Guide Sequence
agacccuuaaaucucccucuc

SEQ ID NO: 17254 - RNA, 21 nt, Artificial Sequence
  Guide Sequence
agaccuugaucaagacccuua

SEQ ID NO: 17255 - RNA, 21 nt, Artificial Sequence
  Guide Sequence
agaggcaggcaggaggggauu

SEQ ID NO: 17256 - RNA, 21 nt, Artificial Sequence
  Guide Sequence
agagggggcugucaguuucug

SEQ ID NO: 17257 - RNA, 21 nt, Artificial Sequence
  Guide Sequence
agauggugggagugcccaccc

SEQ ID NO: 17258 - RNA, 21 nt, Artificial Sequence
  Guide Sequence
agcaaacagcacggggccuca

SEQ ID NO: 17259 - RNA, 21 nt, Artificial Sequence
  Guide Sequence
agcacggggccucaccccgac

SEQ ID NO: 17260 - RNA, 21 nt, Artificial Sequence
  Guide Sequence
agcccaggcuccaggagggua

SEQ ID NO: 17261 - RNA, 21 nt, Artificial Sequence
  Guide Sequence
agccccucaggccccuccuau

SEQ ID NO: 17262 - RNA, 21 nt, Artificial Sequence
  Guide Sequence
agccuugaggcccggucauca

SEQ ID NO: 17263 - RNA, 21 nt, Artificial Sequence
  Guide Sequence
agcgacuaucugcuuucauua

SEQ ID NO: 17264 - RNA, 21 nt, Artificial Sequence
  Guide Sequence
agcuguuuacacacaaggaau

SEQ ID NO: 17265 - RNA, 21 nt, Artificial Sequence
  Guide Sequence
aggaauuguuuaccugagacc

SEQ ID NO: 17266 - RNA, 21 nt, Artificial Sequence
  Guide Sequence
aggagagggggcugucaguuu

SEQ ID NO: 17267 - RNA, 21 nt, Artificial Sequence
  Guide Sequence
aggaggggauucugcagaaaa

SEQ ID NO: 17268 - RNA, 21 nt, Artificial Sequence
  Guide Sequence
aggaggguaauuuagcgacua

SEQ ID NO: 17269 - RNA, 21 nt, Artificial Sequence
  Guide Sequence
aggcaggaggggauucugcag

SEQ ID NO: 17270 - RNA, 21 nt, Artificial Sequence
  Guide Sequence
aggcaggcaggaggggauucu

SEQ ID NO: 17271 - RNA, 21 nt, Artificial Sequence
  Guide Sequence
aggccccuccuaucagaggca

SEQ ID NO: 17272 - RNA, 21 nt, Artificial Sequence
  Guide Sequence
aggcccggucaucaauucccc

SEQ ID NO: 17273 - RNA, 21 nt, Artificial Sequence
  Guide Sequence
aggcuccaggaggguaauuua

SEQ ID NO: 17274 - RNA, 21 nt, Artificial Sequence
  Guide Sequence
agggcuguuugucaaggaaga

SEQ ID NO: 17275 - RNA, 21 nt, Artificial Sequence
  Guide Sequence
aggggauucugcagaaaagca

SEQ ID NO: 17276 - RNA, 21 nt, Artificial Sequence
  Guide Sequence
agggggcugcauugauggagu

SEQ ID NO: 17277 - RNA, 21 nt, Artificial Sequence
  Guide Sequence
agggggcugucaguuucuggg

SEQ ID NO: 17278 - RNA, 21 nt, Artificial Sequence
  Guide Sequence
aggguaauuuagcgacuaucu

SEQ ID NO: 17279 - RNA, 21 nt, Artificial Sequence
  Guide Sequence
agggugcagggcuguuuguca

SEQ ID NO: 17280 - RNA, 21 nt, Artificial Sequence
  Guide Sequence
aguaaccacuaaagaaguugg

SEQ ID NO: 17281 - RNA, 21 nt, Artificial Sequence
  Guide Sequence
aguagccuugaggcccgguca

SEQ ID NO: 17282 - RNA, 21 nt, Artificial Sequence
  Guide Sequence
agucugcccagccccucaggc

SEQ ID NO: 17283 - RNA, 21 nt, Artificial Sequence
  Guide Sequence
agugagaauuagcuguuuaca

SEQ ID NO: 17284 - RNA, 21 nt, Artificial Sequence
  Guide Sequence
agugcccacccagggugcagg

SEQ ID NO: 17285 - RNA, 21 nt, Artificial Sequence
  Guide Sequence
aguguguguuuucaguuuccc

SEQ ID NO: 17286 - RNA, 21 nt, Artificial Sequence
  Guide Sequence
aguuggcccuggagauggugg

SEQ ID NO: 17287 - RNA, 21 nt, Artificial Sequence
  Guide Sequence
aguuucuggguguuagugugu

SEQ ID NO: 17288 - RNA, 21 nt, Artificial Sequence
  Guide Sequence
auagucugcccagccccucag

SEQ ID NO: 17289 - RNA, 21 nt, Artificial Sequence
  Guide Sequence
aucaagacccuuaaaucuccc

SEQ ID NO: 17290 - RNA, 21 nt, Artificial Sequence
  Guide Sequence
aucaauuccccaacgaauggu

SEQ ID NO: 17291 - RNA, 21 nt, Artificial Sequence
  Guide Sequence
aucagaggcaggcaggagggg

SEQ ID NO: 17292 - RNA, 21 nt, Artificial Sequence
  Guide Sequence
aucugcuuucauuagccugcu

SEQ ID NO: 17293 - RNA, 21 nt, Artificial Sequence
  Guide Sequence
auggaguagccuugaggcccg

SEQ ID NO: 17294 - RNA, 21 nt, Artificial Sequence
  Guide Sequence
augguccugcauagucugccc

SEQ ID NO: 17295 - RNA, 21 nt, Artificial Sequence
  Guide Sequence
auggugggagugcccacccag

SEQ ID NO: 17296 - RNA, 21 nt, Artificial Sequence
  Guide Sequence
auuagccugcucguuaacuuu

SEQ ID NO: 17297 - RNA, 21 nt, Artificial Sequence
  Guide Sequence
auuagcuguuuacacacaagg

SEQ ID NO: 17298 - RNA, 21 nt, Artificial Sequence
  Guide Sequence
auuccccaacgaaugguccug

SEQ ID NO: 17299 - RNA, 21 nt, Artificial Sequence
  Guide Sequence
auucugcagaaaagcaaacag

SEQ ID NO: 17300 - RNA, 21 nt, Artificial Sequence
  Guide Sequence
auugauggaguagccuugagg

SEQ ID NO: 17301 - RNA, 21 nt, Artificial Sequence
  Guide Sequence
auuguuuaccugagaccuuga

SEQ ID NO: 17302 - RNA, 21 nt, Artificial Sequence
  Guide Sequence
auuuagcgacuaucugcuuuc

SEQ ID NO: 17303 - RNA, 21 nt, Artificial Sequence
  Guide Sequence
caaacagcacggggccucacc

SEQ ID NO: 17304 - RNA, 21 nt, Artificial Sequence
  Guide Sequence
caacgaaugguccugcauagu

SEQ ID NO: 17305 - RNA, 21 nt, Artificial Sequence
  Guide Sequence
caagacccuuaaaucucccuc

SEQ ID NO: 17306 - RNA, 21 nt, Artificial Sequence
  Guide Sequence
caaggaagagcuagccggggg

SEQ ID NO: 17307 - RNA, 21 nt, Artificial Sequence
  Guide Sequence
caaggaauuguuuaccugaga

SEQ ID NO: 17308 - RNA, 21 nt, Artificial Sequence
  Guide Sequence
caauuccccaacgaauggucc

SEQ ID NO: 17309 - RNA, 21 nt, Artificial Sequence
  Guide Sequence
cacaaggaauuguuuaccuga

SEQ ID NO: 17310 - RNA, 21 nt, Artificial Sequence
  Guide Sequence
cacacaaggaauuguuuaccu

SEQ ID NO: 17311 - RNA, 21 nt, Artificial Sequence
  Guide Sequence
cacccagggugcagggcuguu

SEQ ID NO: 17312 - RNA, 21 nt, Artificial Sequence
  Guide Sequence
caccccgaccucucuggcuga

SEQ ID NO: 17313 - RNA, 21 nt, Artificial Sequence
  Guide Sequence
cacggggccucaccccgaccu

SEQ ID NO: 17314 - RNA, 21 nt, Artificial Sequence
  Guide Sequence
cacuaaagaaguuggcccugg

SEQ ID NO: 17315 - RNA, 21 nt, Artificial Sequence
  Guide Sequence
cagaaaagcaaacagcacggg

SEQ ID NO: 17316 - RNA, 21 nt, Artificial Sequence
  Guide Sequence
cagaggcaggcaggaggggau

SEQ ID NO: 17317 - RNA, 21 nt, Artificial Sequence
  Guide Sequence
cagcacggggccucaccccga

SEQ ID NO: 17318 - RNA, 21 nt, Artificial Sequence
  Guide Sequence
cagccccucaggccccuccua

SEQ ID NO: 17319 - RNA, 21 nt, Artificial Sequence
  Guide Sequence
caggaggggauucugcagaaa

SEQ ID NO: 17320 - RNA, 21 nt, Artificial Sequence
  Guide Sequence
caggaggguaauuuagcgacu

SEQ ID NO: 17321 - RNA, 21 nt, Artificial Sequence
  Guide Sequence
caggcaggaggggauucugca

SEQ ID NO: 17322 - RNA, 21 nt, Artificial Sequence
  Guide Sequence
caggccccuccuaucagaggc

SEQ ID NO: 17323 - RNA, 21 nt, Artificial Sequence
  Guide Sequence
caggcuccaggaggguaauuu

SEQ ID NO: 17324 - RNA, 21 nt, Artificial Sequence
  Guide Sequence
cagggcuguuugucaaggaag

SEQ ID NO: 17325 - RNA, 21 nt, Artificial Sequence
  Guide Sequence
cagggugcagggcuguuuguc

SEQ ID NO: 17326 - RNA, 21 nt, Artificial Sequence
  Guide Sequence
cagugagaauuagcuguuuac

SEQ ID NO: 17327 - RNA, 21 nt, Artificial Sequence
  Guide Sequence
caguuucccuucuuauaaaac

SEQ ID NO: 17328 - RNA, 21 nt, Artificial Sequence
  Guide Sequence
caguuucuggguguuagugug

SEQ ID NO: 17329 - RNA, 21 nt, Artificial Sequence
  Guide Sequence
cauagucugcccagccccuca

SEQ ID NO: 17330 - RNA, 21 nt, Artificial Sequence
  Guide Sequence
caucaauuccccaacgaaugg

SEQ ID NO: 17331 - RNA, 21 nt, Artificial Sequence
  Guide Sequence
cauuagccugcucguuaacuu

SEQ ID NO: 17332 - RNA, 21 nt, Artificial Sequence
  Guide Sequence
cauugauggaguagccuugag

SEQ ID NO: 17333 - RNA, 21 nt, Artificial Sequence
  Guide Sequence
ccaacgaaugguccugcauag

SEQ ID NO: 17334 - RNA, 21 nt, Artificial Sequence
  Guide Sequence
ccacccagggugcagggcugu

SEQ ID NO: 17335 - RNA, 21 nt, Artificial Sequence
  Guide Sequence
ccacuaaagaaguuggcccug

SEQ ID NO: 17336 - RNA, 21 nt, Artificial Sequence
  Guide Sequence
ccagccccucaggccccuccu

SEQ ID NO: 17337 - RNA, 21 nt, Artificial Sequence
  Guide Sequence
ccaggaggguaauuuagcgac

SEQ ID NO: 17338 - RNA, 21 nt, Artificial Sequence
  Guide Sequence
ccaggcuccaggaggguaauu

SEQ ID NO: 17339 - RNA, 21 nt, Artificial Sequence
  Guide Sequence
ccagggugcagggcuguuugu

SEQ ID NO: 17340 - RNA, 21 nt, Artificial Sequence
  Guide Sequence
cccaacgaaugguccugcaua

SEQ ID NO: 17341 - RNA, 21 nt, Artificial Sequence
  Guide Sequence
cccacccagggugcagggcug

SEQ ID NO: 17342 - RNA, 21 nt, Artificial Sequence
  Guide Sequence
cccaggcuccaggaggguaau

SEQ ID NO: 17343 - RNA, 21 nt, Artificial Sequence
  Guide Sequence
cccagggugcagggcuguuug

SEQ ID NO: 17344 - RNA, 21 nt, Artificial Sequence
  Guide Sequence
ccccaacgaaugguccugcau

SEQ ID NO: 17345 - RNA, 21 nt, Artificial Sequence
  Guide Sequence
ccccgaccucucuggcugacu

SEQ ID NO: 17346 - RNA, 21 nt, Artificial Sequence
  Guide Sequence
ccccucaggccccuccuauca

SEQ ID NO: 17347 - RNA, 21 nt, Artificial Sequence
  Guide Sequence
ccccuccuaucagaggcaggc

SEQ ID NO: 17348 - RNA, 21 nt, Artificial Sequence
  Guide Sequence
cccgaccucucuggcugacua

SEQ ID NO: 17349 - RNA, 21 nt, Artificial Sequence
  Guide Sequence
cccggucaucaauuccccaac

SEQ ID NO: 17350 - RNA, 21 nt, Artificial Sequence
  Guide Sequence
cccucaggccccuccuaucag

SEQ ID NO: 17351 - RNA, 21 nt, Artificial Sequence
  Guide Sequence
cccuccuaucagaggcaggca

SEQ ID NO: 17352 - RNA, 21 nt, Artificial Sequence
  Guide Sequence
cccuggagauggugggagugc

SEQ ID NO: 17353 - RNA, 21 nt, Artificial Sequence
  Guide Sequence
cccuuaaaucucccucucaca

SEQ ID NO: 17354 - RNA, 21 nt, Artificial Sequence
  Guide Sequence
cccuucuuauaaaacagugag

SEQ ID NO: 17355 - RNA, 21 nt, Artificial Sequence
  Guide Sequence
ccgaccucucuggcugacuag

SEQ ID NO: 17356 - RNA, 21 nt, Artificial Sequence
  Guide Sequence
ccggucaucaauuccccaacg

SEQ ID NO: 17357 - RNA, 21 nt, Artificial Sequence
  Guide Sequence
ccuaucagaggcaggcaggag

SEQ ID NO: 17358 - RNA, 21 nt, Artificial Sequence
  Guide Sequence
ccucaccccgaccucucuggc

SEQ ID NO: 17359 - RNA, 21 nt, Artificial Sequence
  Guide Sequence
ccucaggccccuccuaucaga

SEQ ID NO: 17360 - RNA, 21 nt, Artificial Sequence
  Guide Sequence
ccuccuaucagaggcaggcag

SEQ ID NO: 17361 - RNA, 21 nt, Artificial Sequence
  Guide Sequence
ccucucuggcugacuagccca

SEQ ID NO: 17362 - RNA, 21 nt, Artificial Sequence
  Guide Sequence
ccugagaccuugaucaagacc

SEQ ID NO: 17363 - RNA, 21 nt, Artificial Sequence
  Guide Sequence
ccugcauagucugcccagccc

SEQ ID NO: 17364 - RNA, 21 nt, Artificial Sequence
  Guide Sequence
ccuggagauggugggagugcc

SEQ ID NO: 17365 - RNA, 21 nt, Artificial Sequence
  Guide Sequence
ccuuaaaucucccucucacac

SEQ ID NO: 17366 - RNA, 21 nt, Artificial Sequence
  Guide Sequence
ccuucuuauaaaacagugaga

SEQ ID NO: 17367 - RNA, 21 nt, Artificial Sequence
  Guide Sequence
ccuugaggcccggucaucaau

SEQ ID NO: 17368 - RNA, 21 nt, Artificial Sequence
  Guide Sequence
ccuugaucaagacccuuaaau

SEQ ID NO: 17369 - RNA, 21 nt, Artificial Sequence
  Guide Sequence
cgaaugguccugcauagucug

SEQ ID NO: 17370 - RNA, 21 nt, Artificial Sequence
  Guide Sequence
cgaccucucuggcugacuagc

SEQ ID NO: 17371 - RNA, 21 nt, Artificial Sequence
  Guide Sequence
cgacuaucugcuuucauuagc

SEQ ID NO: 17372 - RNA, 21 nt, Artificial Sequence
  Guide Sequence
cggggccucaccccgaccucu

SEQ ID NO: 17373 - RNA, 21 nt, Artificial Sequence
  Guide Sequence
cggucaucaauuccccaacga

SEQ ID NO: 17374 - RNA, 21 nt, Artificial Sequence
  Guide Sequence
cuaaagaaguuggcccuggag

SEQ ID NO: 17375 - RNA, 21 nt, Artificial Sequence
  Guide Sequence
cuagcccaggcuccaggaggg

SEQ ID NO: 17376 - RNA, 21 nt, Artificial Sequence
  Guide Sequence
cuaucagaggcaggcaggagg

SEQ ID NO: 17377 - RNA, 21 nt, Artificial Sequence
  Guide Sequence
cuaucugcuuucauuagccug

SEQ ID NO: 17378 - RNA, 21 nt, Artificial Sequence
  Guide Sequence
cucaccccgaccucucuggcu

SEQ ID NO: 17379 - RNA, 21 nt, Artificial Sequence
  Guide Sequence
cucaggccccuccuaucagag

SEQ ID NO: 17380 - RNA, 21 nt, Artificial Sequence
  Guide Sequence
cuccaggaggguaauuuagcg

SEQ ID NO: 17381 - RNA, 21 nt, Artificial Sequence
  Guide Sequence
cuccuaucagaggcaggcagg

SEQ ID NO: 17382 - RNA, 21 nt, Artificial Sequence
  Guide Sequence
cucucuggcugacuagcccag

SEQ ID NO: 17383 - RNA, 21 nt, Artificial Sequence
  Guide Sequence
cucuggcugacuagcccaggc

SEQ ID NO: 17384 - RNA, 21 nt, Artificial Sequence
  Guide Sequence
cugacuagcccaggcuccagg

SEQ ID NO: 17385 - RNA, 21 nt, Artificial Sequence
  Guide Sequence
cugagaccuugaucaagaccc

SEQ ID NO: 17386 - RNA, 21 nt, Artificial Sequence
  Guide Sequence
cugcagaaaagcaaacagcac

SEQ ID NO: 17387 - RNA, 21 nt, Artificial Sequence
  Guide Sequence
cugcauagucugcccagcccc

SEQ ID NO: 17388 - RNA, 21 nt, Artificial Sequence
  Guide Sequence
cugcauugauggaguagccuu

SEQ ID NO: 17389 - RNA, 21 nt, Artificial Sequence
  Guide Sequence
cugcuuucauuagccugcucg

SEQ ID NO: 17390 - RNA, 21 nt, Artificial Sequence
  Guide Sequence
cuggagauggugggagugccc

SEQ ID NO: 17391 - RNA, 21 nt, Artificial Sequence
  Guide Sequence
cuggcugacuagcccaggcuc

SEQ ID NO: 17392 - RNA, 21 nt, Artificial Sequence
  Guide Sequence
cuggguguuaguguguguuuu

SEQ ID NO: 17393 - RNA, 21 nt, Artificial Sequence
  Guide Sequence
cugucaguuucuggguguuag

SEQ ID NO: 17394 - RNA, 21 nt, Artificial Sequence
  Guide Sequence
cuguuuacacacaaggaauug

SEQ ID NO: 17395 - RNA, 21 nt, Artificial Sequence
  Guide Sequence
cuguuugucaaggaagagcua

SEQ ID NO: 17396 - RNA, 21 nt, Artificial Sequence
  Guide Sequence
cuuaaaucucccucucacacu

SEQ ID NO: 17397 - RNA, 21 nt, Artificial Sequence
  Guide Sequence
cuugaggcccggucaucaauu

SEQ ID NO: 17398 - RNA, 21 nt, Artificial Sequence
  Guide Sequence
cuugaucaagacccuuaaauc

SEQ ID NO: 17399 - RNA, 21 nt, Artificial Sequence
  Guide Sequence
cuuucauuagccugcucguua

SEQ ID NO: 17400 - RNA, 21 nt, Artificial Sequence
  Guide Sequence
gaaaagcaaacagcacggggc

SEQ ID NO: 17401 - RNA, 21 nt, Artificial Sequence
  Guide Sequence
gaaguuggcccuggagauggu

SEQ ID NO: 17402 - RNA, 21 nt, Artificial Sequence
  Guide Sequence
gaaugguccugcauagucugc

SEQ ID NO: 17403 - RNA, 21 nt, Artificial Sequence
  Guide Sequence
gaauuagcuguuuacacacaa

SEQ ID NO: 17404 - RNA, 21 nt, Artificial Sequence
  Guide Sequence
gaauuguuuaccugagaccuu

SEQ ID NO: 17405 - RNA, 21 nt, Artificial Sequence
  Guide Sequence
gacccuuaaaucucccucuca

SEQ ID NO: 17406 - RNA, 21 nt, Artificial Sequence
  Guide Sequence
gaccucucuggcugacuagcc

SEQ ID NO: 17407 - RNA, 21 nt, Artificial Sequence
  Guide Sequence
gaccuugaucaagacccuuaa

SEQ ID NO: 17408 - RNA, 21 nt, Artificial Sequence
  Guide Sequence
gacuagcccaggcuccaggag

SEQ ID NO: 17409 - RNA, 21 nt, Artificial Sequence
  Guide Sequence
gacuaucugcuuucauuagcc

SEQ ID NO: 17410 - RNA, 21 nt, Artificial Sequence
  Guide Sequence
gagaauuagcuguuuacacac

SEQ ID NO: 17411 - RNA, 21 nt, Artificial Sequence
  Guide Sequence
gagaccuugaucaagacccuu

SEQ ID NO: 17412 - RNA, 21 nt, Artificial Sequence
  Guide Sequence
gagagggggcugucaguuucu

SEQ ID NO: 17413 - RNA, 21 nt, Artificial Sequence
  Guide Sequence
gagauggugggagugcccacc

SEQ ID NO: 17414 - RNA, 21 nt, Artificial Sequence
  Guide Sequence
gaggagagggggcugucaguu

SEQ ID NO: 17415 - RNA, 21 nt, Artificial Sequence
  Guide Sequence
gaggcaggcaggaggggauuc

SEQ ID NO: 17416 - RNA, 21 nt, Artificial Sequence
  Guide Sequence
gaggcccggucaucaauuccc

SEQ ID NO: 17417 - RNA, 21 nt, Artificial Sequence
  Guide Sequence
gaggggauucugcagaaaagc

SEQ ID NO: 17418 - RNA, 21 nt, Artificial Sequence
  Guide Sequence
gagggggcugucaguuucugg

SEQ ID NO: 17419 - RNA, 21 nt, Artificial Sequence
  Guide Sequence
gaggguaauuuagcgacuauc

SEQ ID NO: 17420 - RNA, 21 nt, Artificial Sequence
  Guide Sequence
gaguagccuugaggcccgguc

SEQ ID NO: 17421 - RNA, 21 nt, Artificial Sequence
  Guide Sequence
gagugcccacccagggugcag

SEQ ID NO: 17422 - RNA, 21 nt, Artificial Sequence
  Guide Sequence
gauaguaaccacuaaagaagu

SEQ ID NO: 17423 - RNA, 21 nt, Artificial Sequence
  Guide Sequence
gaucaagacccuuaaaucucc

SEQ ID NO: 17424 - RNA, 21 nt, Artificial Sequence
  Guide Sequence
gauggaguagccuugaggccc

SEQ ID NO: 17425 - RNA, 21 nt, Artificial Sequence
  Guide Sequence
gauggugggagugcccaccca

SEQ ID NO: 17426 - RNA, 21 nt, Artificial Sequence
  Guide Sequence
gauucugcagaaaagcaaaca

SEQ ID NO: 17427 - RNA, 21 nt, Artificial Sequence
  Guide Sequence
gcaaacagcacggggccucac

SEQ ID NO: 17428 - RNA, 21 nt, Artificial Sequence
  Guide Sequence
gcagaaaagcaaacagcacgg

SEQ ID NO: 17429 - RNA, 21 nt, Artificial Sequence
  Guide Sequence
gcaggaggggauucugcagaa

SEQ ID NO: 17430 - RNA, 21 nt, Artificial Sequence
  Guide Sequence
gcaggcaggaggggauucugc

SEQ ID NO: 17431 - RNA, 21 nt, Artificial Sequence
  Guide Sequence
gcagggcuguuugucaaggaa

SEQ ID NO: 17432 - RNA, 21 nt, Artificial Sequence
  Guide Sequence
gcauagucugcccagccccuc

SEQ ID NO: 17433 - RNA, 21 nt, Artificial Sequence
  Guide Sequence
gcauugauggaguagccuuga

SEQ ID NO: 17434 - RNA, 21 nt, Artificial Sequence
  Guide Sequence
gcccacccagggugcagggcu

SEQ ID NO: 17435 - RNA, 21 nt, Artificial Sequence
  Guide Sequence
gcccaggcuccaggaggguaa

SEQ ID NO: 17436 - RNA, 21 nt, Artificial Sequence
  Guide Sequence
gccccucaggccccuccuauc

SEQ ID NO: 17437 - RNA, 21 nt, Artificial Sequence
  Guide Sequence
gccccuccuaucagaggcagg

SEQ ID NO: 17438 - RNA, 21 nt, Artificial Sequence
  Guide Sequence
gcccggucaucaauuccccaa

SEQ ID NO: 17439 - RNA, 21 nt, Artificial Sequence
  Guide Sequence
gcccuggagauggugggagug

SEQ ID NO: 17440 - RNA, 21 nt, Artificial Sequence
  Guide Sequence
gccucaccccgaccucucugg

SEQ ID NO: 17441 - RNA, 21 nt, Artificial Sequence
  Guide Sequence
gccuugaggcccggucaucaa

SEQ ID NO: 17442 - RNA, 21 nt, Artificial Sequence
  Guide Sequence
gcgacuaucugcuuucauuag

SEQ ID NO: 17443 - RNA, 21 nt, Artificial Sequence
  Guide Sequence
gcuccaggaggguaauuuagc

SEQ ID NO: 17444 - RNA, 21 nt, Artificial Sequence
  Guide Sequence
gcugacuagcccaggcuccag

SEQ ID NO: 17445 - RNA, 21 nt, Artificial Sequence
  Guide Sequence
gcugcauugauggaguagccu

SEQ ID NO: 17446 - RNA, 21 nt, Artificial Sequence
  Guide Sequence
gcugucaguuucuggguguua

SEQ ID NO: 17447 - RNA, 21 nt, Artificial Sequence
  Guide Sequence
gcuguuuacacacaaggaauu

SEQ ID NO: 17448 - RNA, 21 nt, Artificial Sequence
  Guide Sequence
gcuguuugucaaggaagagcu

SEQ ID NO: 17449 - RNA, 21 nt, Artificial Sequence
  Guide Sequence
gcuuucauuagccugcucguu

SEQ ID NO: 17450 - RNA, 21 nt, Artificial Sequence
  Guide Sequence
ggaauuguuuaccugagaccu

SEQ ID NO: 17451 - RNA, 21 nt, Artificial Sequence
  Guide Sequence
ggagagggggcugucaguuuc

SEQ ID NO: 17452 - RNA, 21 nt, Artificial Sequence
  Guide Sequence
ggagauggugggagugcccac

SEQ ID NO: 17453 - RNA, 21 nt, Artificial Sequence
  Guide Sequence
ggaggggauucugcagaaaag

SEQ ID NO: 17454 - RNA, 21 nt, Artificial Sequence
  Guide Sequence
ggaggguaauuuagcgacuau

SEQ ID NO: 17455 - RNA, 21 nt, Artificial Sequence
  Guide Sequence
ggaguagccuugaggcccggu

SEQ ID NO: 17456 - RNA, 21 nt, Artificial Sequence
  Guide Sequence
ggagugcccacccagggugca

SEQ ID NO: 17457 - RNA, 21 nt, Artificial Sequence
  Guide Sequence
ggauaguaaccacuaaagaag

SEQ ID NO: 17458 - RNA, 21 nt, Artificial Sequence
  Guide Sequence
ggauucugcagaaaagcaaac

SEQ ID NO: 17459 - RNA, 21 nt, Artificial Sequence
  Guide Sequence
ggcaggaggggauucugcaga

SEQ ID NO: 17460 - RNA, 21 nt, Artificial Sequence
  Guide Sequence
ggcaggcaggaggggauucug

SEQ ID NO: 17461 - RNA, 21 nt, Artificial Sequence
  Guide Sequence
ggccccuccuaucagaggcag

SEQ ID NO: 17462 - RNA, 21 nt, Artificial Sequence
  Guide Sequence
ggcccggucaucaauucccca

SEQ ID NO: 17463 - RNA, 21 nt, Artificial Sequence
  Guide Sequence
ggcccuggagauggugggagu

SEQ ID NO: 17464 - RNA, 21 nt, Artificial Sequence
  Guide Sequence
ggccucaccccgaccucucug

SEQ ID NO: 17465 - RNA, 21 nt, Artificial Sequence
  Guide Sequence
ggcuccaggaggguaauuuag

SEQ ID NO: 17466 - RNA, 21 nt, Artificial Sequence
  Guide Sequence
ggcugacuagcccaggcucca

SEQ ID NO: 17467 - RNA, 21 nt, Artificial Sequence
  Guide Sequence
ggcugcauugauggaguagcc

SEQ ID NO: 17468 - RNA, 21 nt, Artificial Sequence
  Guide Sequence
ggcugucaguuucuggguguu

SEQ ID NO: 17469 - RNA, 21 nt, Artificial Sequence
  Guide Sequence
ggcuguuugucaaggaagagc

SEQ ID NO: 17470 - RNA, 21 nt, Artificial Sequence
  Guide Sequence
gggagugcccacccagggugc

SEQ ID NO: 17471 - RNA, 21 nt, Artificial Sequence
  Guide Sequence
gggauaguaaccacuaaagaa

SEQ ID NO: 17472 - RNA, 21 nt, Artificial Sequence
  Guide Sequence
gggauucugcagaaaagcaaa

SEQ ID NO: 17473 - RNA, 21 nt, Artificial Sequence
  Guide Sequence
gggccucaccccgaccucucu

SEQ ID NO: 17474 - RNA, 21 nt, Artificial Sequence
  Guide Sequence
gggcugcauugauggaguagc

SEQ ID NO: 17475 - RNA, 21 nt, Artificial Sequence
  Guide Sequence
gggcugucaguuucugggugu

SEQ ID NO: 17476 - RNA, 21 nt, Artificial Sequence
  Guide Sequence
gggcuguuugucaaggaagag

SEQ ID NO: 17477 - RNA, 21 nt, Artificial Sequence
  Guide Sequence
ggggauucugcagaaaagcaa

SEQ ID NO: 17478 - RNA, 21 nt, Artificial Sequence
  Guide Sequence
ggggccucaccccgaccucuc

SEQ ID NO: 17479 - RNA, 21 nt, Artificial Sequence
  Guide Sequence
ggggcugcauugauggaguag

SEQ ID NO: 17480 - RNA, 21 nt, Artificial Sequence
  Guide Sequence
ggggcugucaguuucugggug

SEQ ID NO: 17481 - RNA, 21 nt, Artificial Sequence
  Guide Sequence
gggggcugcauugauggagua

SEQ ID NO: 17482 - RNA, 21 nt, Artificial Sequence
  Guide Sequence
gggggcugucaguuucugggu

SEQ ID NO: 17483 - RNA, 21 nt, Artificial Sequence
  Guide Sequence
ggggggugggugaggagaggg

SEQ ID NO: 17484 - RNA, 21 nt, Artificial Sequence
  Guide Sequence
gggggugggugaggagagggg

SEQ ID NO: 17485 - RNA, 21 nt, Artificial Sequence
  Guide Sequence
ggggugggugaggagaggggg

SEQ ID NO: 17486 - RNA, 21 nt, Artificial Sequence
  Guide Sequence
ggguaauuuagcgacuaucug

SEQ ID NO: 17487 - RNA, 21 nt, Artificial Sequence
  Guide Sequence
gggugaggagagggggcuguc

SEQ ID NO: 17488 - RNA, 21 nt, Artificial Sequence
  Guide Sequence
gggugcagggcuguuugucaa

SEQ ID NO: 17489 - RNA, 21 nt, Artificial Sequence
  Guide Sequence
gggugggugaggagagggggc

SEQ ID NO: 17490 - RNA, 21 nt, Artificial Sequence
  Guide Sequence
ggguguuaguguguguuuuca

SEQ ID NO: 17491 - RNA, 21 nt, Artificial Sequence
  Guide Sequence
gguaauuuagcgacuaucugc

SEQ ID NO: 17492 - RNA, 21 nt, Artificial Sequence
  Guide Sequence
ggucaucaauuccccaacgaa

SEQ ID NO: 17493 - RNA, 21 nt, Artificial Sequence
  Guide Sequence
gguccugcauagucugcccag

SEQ ID NO: 17494 - RNA, 21 nt, Artificial Sequence
  Guide Sequence
ggugaggagagggggcuguca

SEQ ID NO: 17495 - RNA, 21 nt, Artificial Sequence
  Guide Sequence
ggugcagggcuguuugucaag

SEQ ID NO: 17496 - RNA, 21 nt, Artificial Sequence
  Guide Sequence
ggugggagugcccacccaggg

SEQ ID NO: 17497 - RNA, 21 nt, Artificial Sequence
  Guide Sequence
ggugggugaggagagggggcu

SEQ ID NO: 17498 - RNA, 21 nt, Artificial Sequence
  Guide Sequence
gguguuaguguguguuuucag

SEQ ID NO: 17499 - RNA, 21 nt, Artificial Sequence
  Guide Sequence
guaaccacuaaagaaguuggc

SEQ ID NO: 17500 - RNA, 21 nt, Artificial Sequence
  Guide Sequence
guaauuuagcgacuaucugcu

SEQ ID NO: 17501 - RNA, 21 nt, Artificial Sequence
  Guide Sequence
guagccuugaggcccggucau

SEQ ID NO: 17502 - RNA, 21 nt, Artificial Sequence
  Guide Sequence
gucaaggaagagcuagccggg

SEQ ID NO: 17503 - RNA, 21 nt, Artificial Sequence
  Guide Sequence
gucaguuucuggguguuagug

SEQ ID NO: 17504 - RNA, 21 nt, Artificial Sequence
  Guide Sequence
gucaucaauuccccaacgaau

SEQ ID NO: 17505 - RNA, 21 nt, Artificial Sequence
  Guide Sequence
guccugcauagucugcccagc

SEQ ID NO: 17506 - RNA, 21 nt, Artificial Sequence
  Guide Sequence
gucugcccagccccucaggcc

SEQ ID NO: 17507 - RNA, 21 nt, Artificial Sequence
  Guide Sequence
gugagaauuagcuguuuacac

SEQ ID NO: 17508 - RNA, 21 nt, Artificial Sequence
  Guide Sequence
gugaggagagggggcugucag

SEQ ID NO: 17509 - RNA, 21 nt, Artificial Sequence
  Guide Sequence
gugcagggcuguuugucaagg

SEQ ID NO: 17510 - RNA, 21 nt, Artificial Sequence
  Guide Sequence
gugcccacccagggugcaggg

SEQ ID NO: 17511 - RNA, 21 nt, Artificial Sequence
  Guide Sequence
gugggagugcccacccagggu

SEQ ID NO: 17512 - RNA, 21 nt, Artificial Sequence
  Guide Sequence
gugggugaggagagggggcug

SEQ ID NO: 17513 - RNA, 21 nt, Artificial Sequence
  Guide Sequence
guguguguuuucaguuucccu

SEQ ID NO: 17514 - RNA, 21 nt, Artificial Sequence
  Guide Sequence
guguguuuucaguuucccuuc

SEQ ID NO: 17515 - RNA, 21 nt, Artificial Sequence
  Guide Sequence
guguuaguguguguuuucagu

SEQ ID NO: 17516 - RNA, 21 nt, Artificial Sequence
  Guide Sequence
guguuuucaguuucccuucuu

SEQ ID NO: 17517 - RNA, 21 nt, Artificial Sequence
  Guide Sequence
guuaguguguguuuucaguuu

SEQ ID NO: 17518 - RNA, 21 nt, Artificial Sequence
  Guide Sequence
guuggcccuggagaugguggg

SEQ ID NO: 17519 - RNA, 21 nt, Artificial Sequence
  Guide Sequence
guuuacacacaaggaauuguu

SEQ ID NO: 17520 - RNA, 21 nt, Artificial Sequence
  Guide Sequence
guuuaccugagaccuugauca

SEQ ID NO: 17521 - RNA, 21 nt, Artificial Sequence
  Guide Sequence
guuucccuucuuauaaaacag

SEQ ID NO: 17522 - RNA, 21 nt, Artificial Sequence
  Guide Sequence
guuucuggguguuagugugug

SEQ ID NO: 17523 - RNA, 21 nt, Artificial Sequence
  Guide Sequence
guuugucaaggaagagcuagc

SEQ ID NO: 17524 - RNA, 21 nt, Artificial Sequence
  Guide Sequence
guuuucaguuucccuucuuau

SEQ ID NO: 17525 - RNA, 21 nt, Artificial Sequence
  Guide Sequence
uaaaacagugagaauuagcug

SEQ ID NO: 17526 - RNA, 21 nt, Artificial Sequence
  Guide Sequence
uaaagaaguuggcccuggaga

SEQ ID NO: 17527 - RNA, 21 nt, Artificial Sequence
  Guide Sequence
uaaaucucccucucacacuac

SEQ ID NO: 17528 - RNA, 21 nt, Artificial Sequence
  Guide Sequence
uaaccacuaaagaaguuggcc

SEQ ID NO: 17529 - RNA, 21 nt, Artificial Sequence
  Guide Sequence
uaauuuagcgacuaucugcuu

SEQ ID NO: 17530 - RNA, 21 nt, Artificial Sequence
  Guide Sequence
uacacacaaggaauuguuuac

SEQ ID NO: 17531 - RNA, 21 nt, Artificial Sequence
  Guide Sequence
uaccugagaccuugaucaaga

SEQ ID NO: 17532 - RNA, 21 nt, Artificial Sequence
  Guide Sequence
uagcccaggcuccaggagggu

SEQ ID NO: 17533 - RNA, 21 nt, Artificial Sequence
  Guide Sequence
uagccuugaggcccggucauc

SEQ ID NO: 17534 - RNA, 21 nt, Artificial Sequence
  Guide Sequence
uagcgacuaucugcuuucauu

SEQ ID NO: 17535 - RNA, 21 nt, Artificial Sequence
  Guide Sequence
uagcuguuuacacacaaggaa

SEQ ID NO: 17536 - RNA, 21 nt, Artificial Sequence
  Guide Sequence
uaguaaccacuaaagaaguug

SEQ ID NO: 17537 - RNA, 21 nt, Artificial Sequence
  Guide Sequence
uagucugcccagccccucagg

SEQ ID NO: 17538 - RNA, 21 nt, Artificial Sequence
  Guide Sequence
uaguguguguuuucaguuucc

SEQ ID NO: 17539 - RNA, 21 nt, Artificial Sequence
  Guide Sequence
uaucagaggcaggcaggaggg

SEQ ID NO: 17540 - RNA, 21 nt, Artificial Sequence
  Guide Sequence
uaucugcuuucauuagccugc

SEQ ID NO: 17541 - RNA, 21 nt, Artificial Sequence
  Guide Sequence
ucaagacccuuaaaucucccu

SEQ ID NO: 17542 - RNA, 21 nt, Artificial Sequence
  Guide Sequence
ucaaggaagagcuagccgggg

SEQ ID NO: 17543 - RNA, 21 nt, Artificial Sequence
  Guide Sequence
ucaauuccccaacgaaugguc

SEQ ID NO: 17544 - RNA, 21 nt, Artificial Sequence
  Guide Sequence
ucaccccgaccucucuggcug

SEQ ID NO: 17545 - RNA, 21 nt, Artificial Sequence
  Guide Sequence
ucagaggcaggcaggagggga

SEQ ID NO: 17546 - RNA, 21 nt, Artificial Sequence
  Guide Sequence
ucaggccccuccuaucagagg

SEQ ID NO: 17547 - RNA, 21 nt, Artificial Sequence
  Guide Sequence
ucaguuucuggguguuagugu

SEQ ID NO: 17548 - RNA, 21 nt, Artificial Sequence
  Guide Sequence
ucaucaauuccccaacgaaug

SEQ ID NO: 17549 - RNA, 21 nt, Artificial Sequence
  Guide Sequence
ucauuagccugcucguuaacu

SEQ ID NO: 17550 - RNA, 21 nt, Artificial Sequence
  Guide Sequence
uccaggaggguaauuuagcga

SEQ ID NO: 17551 - RNA, 21 nt, Artificial Sequence
  Guide Sequence
uccccaacgaaugguccugca

SEQ ID NO: 17552 - RNA, 21 nt, Artificial Sequence
  Guide Sequence
ucccuucuuauaaaacaguga

SEQ ID NO: 17553 - RNA, 21 nt, Artificial Sequence
  Guide Sequence
uccuaucagaggcaggcagga

SEQ ID NO: 17554 - RNA, 21 nt, Artificial Sequence
  Guide Sequence
uccugcauagucugcccagcc

SEQ ID NO: 17555 - RNA, 21 nt, Artificial Sequence
  Guide Sequence
ucucuggcugacuagcccagg

SEQ ID NO: 17556 - RNA, 21 nt, Artificial Sequence
  Guide Sequence
ucugcagaaaagcaaacagca

SEQ ID NO: 17557 - RNA, 21 nt, Artificial Sequence
  Guide Sequence
ucugcccagccccucaggccc

SEQ ID NO: 17558 - RNA, 21 nt, Artificial Sequence
  Guide Sequence
ucugcuuucauuagccugcuc

SEQ ID NO: 17559 - RNA, 21 nt, Artificial Sequence
  Guide Sequence
ucuggcugacuagcccaggcu

SEQ ID NO: 17560 - RNA, 21 nt, Artificial Sequence
  Guide Sequence
ucuggguguuaguguguguuu

SEQ ID NO: 17561 - RNA, 21 nt, Artificial Sequence
  Guide Sequence
ugacuagcccaggcuccagga

SEQ ID NO: 17562 - RNA, 21 nt, Artificial Sequence
  Guide Sequence
ugagaauuagcuguuuacaca

SEQ ID NO: 17563 - RNA, 21 nt, Artificial Sequence
  Guide Sequence
ugagaccuugaucaagacccu

SEQ ID NO: 17564 - RNA, 21 nt, Artificial Sequence
  Guide Sequence
ugaggagagggggcugucagu

SEQ ID NO: 17565 - RNA, 21 nt, Artificial Sequence
  Guide Sequence
ugaggcccggucaucaauucc

SEQ ID NO: 17566 - RNA, 21 nt, Artificial Sequence
  Guide Sequence
ugaucaagacccuuaaaucuc

SEQ ID NO: 17567 - RNA, 21 nt, Artificial Sequence
  Guide Sequence
ugauggaguagccuugaggcc

SEQ ID NO: 17568 - RNA, 21 nt, Artificial Sequence
  Guide Sequence
ugcagaaaagcaaacagcacg

SEQ ID NO: 17569 - RNA, 21 nt, Artificial Sequence
  Guide Sequence
ugcagggcuguuugucaagga

SEQ ID NO: 17570 - RNA, 21 nt, Artificial Sequence
  Guide Sequence
ugcauagucugcccagccccu

SEQ ID NO: 17571 - RNA, 21 nt, Artificial Sequence
  Guide Sequence
ugcauugauggaguagccuug

SEQ ID NO: 17572 - RNA, 21 nt, Artificial Sequence
  Guide Sequence
ugcccacccagggugcagggc

SEQ ID NO: 17573 - RNA, 21 nt, Artificial Sequence
  Guide Sequence
ugcccagccccucaggccccu

SEQ ID NO: 17574 - RNA, 21 nt, Artificial Sequence
  Guide Sequence
ugcuuucauuagccugcucgu

SEQ ID NO: 17575 - RNA, 21 nt, Artificial Sequence
  Guide Sequence
uggagauggugggagugccca

SEQ ID NO: 17576 - RNA, 21 nt, Artificial Sequence
  Guide Sequence
uggaguagccuugaggcccgg

SEQ ID NO: 17577 - RNA, 21 nt, Artificial Sequence
  Guide Sequence
uggcccuggagauggugggag

SEQ ID NO: 17578 - RNA, 21 nt, Artificial Sequence
  Guide Sequence
uggcugacuagcccaggcucc

SEQ ID NO: 17579 - RNA, 21 nt, Artificial Sequence
  Guide Sequence
ugggagugcccacccagggug

SEQ ID NO: 17580 - RNA, 21 nt, Artificial Sequence
  Guide Sequence
ugggugaggagagggggcugu

SEQ ID NO: 17581 - RNA, 21 nt, Artificial Sequence
  Guide Sequence
uggguguuaguguguguuuuc

SEQ ID NO: 17582 - RNA, 21 nt, Artificial Sequence
  Guide Sequence
ugguccugcauagucugccca

SEQ ID NO: 17583 - RNA, 21 nt, Artificial Sequence
  Guide Sequence
uggugggagugcccacccagg

SEQ ID NO: 17584 - RNA, 21 nt, Artificial Sequence
  Guide Sequence
ugucaaggaagagcuagccgg

SEQ ID NO: 17585 - RNA, 21 nt, Artificial Sequence
  Guide Sequence
ugucaguuucuggguguuagu

SEQ ID NO: 17586 - RNA, 21 nt, Artificial Sequence
  Guide Sequence
uguguguuuucaguuucccuu

SEQ ID NO: 17587 - RNA, 21 nt, Artificial Sequence
  Guide Sequence
uguguuuucaguuucccuucu

SEQ ID NO: 17588 - RNA, 21 nt, Artificial Sequence
  Guide Sequence
uguuaguguguguuuucaguu

SEQ ID NO: 17589 - RNA, 21 nt, Artificial Sequence
  Guide Sequence
uguuuacacacaaggaauugu

SEQ ID NO: 17590 - RNA, 21 nt, Artificial Sequence
  Guide Sequence
uguuuaccugagaccuugauc

SEQ ID NO: 17591 - RNA, 21 nt, Artificial Sequence
  Guide Sequence
uguuugucaaggaagagcuag

SEQ ID NO: 17592 - RNA, 21 nt, Artificial Sequence
  Guide Sequence
uguuuucaguuucccuucuua

SEQ ID NO: 17593 - RNA, 21 nt, Artificial Sequence
  Guide Sequence
uuaaaucucccucucacacua

SEQ ID NO: 17594 - RNA, 21 nt, Artificial Sequence
  Guide Sequence
uuaccugagaccuugaucaag

SEQ ID NO: 17595 - RNA, 21 nt, Artificial Sequence
  Guide Sequence
uuagcgacuaucugcuuucau

SEQ ID NO: 17596 - RNA, 21 nt, Artificial Sequence
  Guide Sequence
uuagcuguuuacacacaagga

SEQ ID NO: 17597 - RNA, 21 nt, Artificial Sequence
  Guide Sequence
uuaguguguguuuucaguuuc

SEQ ID NO: 17598 - RNA, 21 nt, Artificial Sequence
  Guide Sequence
uucauuagccugcucguuaac

SEQ ID NO: 17599 - RNA, 21 nt, Artificial Sequence
  Guide Sequence
uuccccaacgaaugguccugc

SEQ ID NO: 17600 - RNA, 21 nt, Artificial Sequence
  Guide Sequence
uucccuucuuauaaaacagug

SEQ ID NO: 17601 - RNA, 21 nt, Artificial Sequence
  Guide Sequence
uucugcagaaaagcaaacagc

SEQ ID NO: 17602 - RNA, 21 nt, Artificial Sequence
  Guide Sequence
uucuggguguuaguguguguu

SEQ ID NO: 17603 - RNA, 21 nt, Artificial Sequence
  Guide Sequence
uugaggcccggucaucaauuc

SEQ ID NO: 17604 - RNA, 21 nt, Artificial Sequence
  Guide Sequence
uugaucaagacccuuaaaucu

SEQ ID NO: 17605 - RNA, 21 nt, Artificial Sequence
  Guide Sequence
uugauggaguagccuugaggc

SEQ ID NO: 17606 - RNA, 21 nt, Artificial Sequence
  Guide Sequence
uuggcccuggagaugguggga

SEQ ID NO: 17607 - RNA, 21 nt, Artificial Sequence
  Guide Sequence
uugucaaggaagagcuagccg

SEQ ID NO: 17608 - RNA, 21 nt, Artificial Sequence
  Guide Sequence
uuguuuaccugagaccuugau

SEQ ID NO: 17609 - RNA, 21 nt, Artificial Sequence
  Guide Sequence
uuuaccugagaccuugaucaa

SEQ ID NO: 17610 - RNA, 21 nt, Artificial Sequence
  Guide Sequence
uuuagcgacuaucugcuuuca

SEQ ID NO: 17611 - RNA, 21 nt, Artificial Sequence
  Guide Sequence
uuucauuagccugcucguuaa

SEQ ID NO: 17612 - RNA, 21 nt, Artificial Sequence
  Guide Sequence
uuucuggguguuagugugugu

SEQ ID NO: 17613 - RNA, 21 nt, Artificial Sequence
  Guide Sequence
uuugucaaggaagagcuagcc

SEQ ID NO: 17614 - RNA, 22 nt, Artificial Sequence
  Guide Sequence
aaaacagugagaauuagcuguu

SEQ ID NO: 17615 - RNA, 22 nt, Artificial Sequence
  Guide Sequence
aaaagcaaacagcacggggccu

SEQ ID NO: 17616 - RNA, 22 nt, Artificial Sequence
  Guide Sequence
aaacagcacggggccucacccc

SEQ ID NO: 17617 - RNA, 22 nt, Artificial Sequence
  Guide Sequence
aaacagugagaauuagcuguuu

SEQ ID NO: 17618 - RNA, 22 nt, Artificial Sequence
  Guide Sequence
aaagaaguuggcccuggagaug

SEQ ID NO: 17619 - RNA, 22 nt, Artificial Sequence
  Guide Sequence
aaagcaaacagcacggggccuc

SEQ ID NO: 17620 - RNA, 22 nt, Artificial Sequence
  Guide Sequence
aacagcacggggccucaccccg

SEQ ID NO: 17621 - RNA, 22 nt, Artificial Sequence
  Guide Sequence
aacagugagaauuagcuguuua

SEQ ID NO: 17622 - RNA, 22 nt, Artificial Sequence
  Guide Sequence
aaccacuaaagaaguuggcccu

SEQ ID NO: 17623 - RNA, 22 nt, Artificial Sequence
  Guide Sequence
aacgaaugguccugcauagucu

SEQ ID NO: 17624 - RNA, 22 nt, Artificial Sequence
  Guide Sequence
aagaaguuggcccuggagaugg

SEQ ID NO: 17625 - RNA, 22 nt, Artificial Sequence
  Guide Sequence
aagacccuuaaaucucccucuc

SEQ ID NO: 17626 - RNA, 22 nt, Artificial Sequence
  Guide Sequence
aagcaaacagcacggggccuca

SEQ ID NO: 17627 - RNA, 22 nt, Artificial Sequence
  Guide Sequence
aaggaauuguuuaccugagacc

SEQ ID NO: 17628 - RNA, 22 nt, Artificial Sequence
  Guide Sequence
aaguuggcccuggagauggugg

SEQ ID NO: 17629 - RNA, 22 nt, Artificial Sequence
  Guide Sequence
aaugguccugcauagucugccc

SEQ ID NO: 17630 - RNA, 22 nt, Artificial Sequence
  Guide Sequence
aauuagcuguuuacacacaagg

SEQ ID NO: 17631 - RNA, 22 nt, Artificial Sequence
  Guide Sequence
aauuccccaacgaaugguccug

SEQ ID NO: 17632 - RNA, 22 nt, Artificial Sequence
  Guide Sequence
aauuguuuaccugagaccuuga

SEQ ID NO: 17633 - RNA, 22 nt, Artificial Sequence
  Guide Sequence
aauuuagcgacuaucugcuuuc

SEQ ID NO: 17634 - RNA, 22 nt, Artificial Sequence
  Guide Sequence
acaaggaauuguuuaccugaga

SEQ ID NO: 17635 - RNA, 22 nt, Artificial Sequence
  Guide Sequence
acacaaggaauuguuuaccuga

SEQ ID NO: 17636 - RNA, 22 nt, Artificial Sequence
  Guide Sequence
acacacaaggaauuguuuaccu

SEQ ID NO: 17637 - RNA, 22 nt, Artificial Sequence
  Guide Sequence
acagcacggggccucaccccga

SEQ ID NO: 17638 - RNA, 22 nt, Artificial Sequence
  Guide Sequence
acagugagaauuagcuguuuac

SEQ ID NO: 17639 - RNA, 22 nt, Artificial Sequence
  Guide Sequence
accacuaaagaaguuggcccug

SEQ ID NO: 17640 - RNA, 22 nt, Artificial Sequence
  Guide Sequence
acccagggugcagggcuguuug

SEQ ID NO: 17641 - RNA, 22 nt, Artificial Sequence
  Guide Sequence
accccgaccucucuggcugacu

SEQ ID NO: 17642 - RNA, 22 nt, Artificial Sequence
  Guide Sequence
acccuuaaaucucccucucaca

SEQ ID NO: 17643 - RNA, 22 nt, Artificial Sequence
  Guide Sequence
accucucuggcugacuagccca

SEQ ID NO: 17644 - RNA, 22 nt, Artificial Sequence
  Guide Sequence
accugagaccuugaucaagacc

SEQ ID NO: 17645 - RNA, 22 nt, Artificial Sequence
  Guide Sequence
accuugaucaagacccuuaaau

SEQ ID NO: 17646 - RNA, 22 nt, Artificial Sequence
  Guide Sequence
acgaaugguccugcauagucug

SEQ ID NO: 17647 - RNA, 22 nt, Artificial Sequence
  Guide Sequence
acggggccucaccccgaccucu

SEQ ID NO: 17648 - RNA, 22 nt, Artificial Sequence
  Guide Sequence
acuaaagaaguuggcccuggag

SEQ ID NO: 17649 - RNA, 22 nt, Artificial Sequence
  Guide Sequence
acuagcccaggcuccaggaggg

SEQ ID NO: 17650 - RNA, 22 nt, Artificial Sequence
  Guide Sequence
acuaucugcuuucauuagccug

SEQ ID NO: 17651 - RNA, 22 nt, Artificial Sequence
  Guide Sequence
agaaaagcaaacagcacggggc

SEQ ID NO: 17652 - RNA, 22 nt, Artificial Sequence
  Guide Sequence
agaaguuggcccuggagauggu

SEQ ID NO: 17653 - RNA, 22 nt, Artificial Sequence
  Guide Sequence
agaauuagcuguuuacacacaa

SEQ ID NO: 17654 - RNA, 22 nt, Artificial Sequence
  Guide Sequence
agacccuuaaaucucccucuca

SEQ ID NO: 17655 - RNA, 22 nt, Artificial Sequence
  Guide Sequence
agaccuugaucaagacccuuaa

SEQ ID NO: 17656 - RNA, 22 nt, Artificial Sequence
  Guide Sequence
agaggcaggcaggaggggauuc

SEQ ID NO: 17657 - RNA, 22 nt, Artificial Sequence
  Guide Sequence
agagggggcugucaguuucugg

SEQ ID NO: 17658 - RNA, 22 nt, Artificial Sequence
  Guide Sequence
agauggugggagugcccaccca

SEQ ID NO: 17659 - RNA, 22 nt, Artificial Sequence
  Guide Sequence
agcaaacagcacggggccucac

SEQ ID NO: 17660 - RNA, 22 nt, Artificial Sequence
  Guide Sequence
agcacggggccucaccccgacc

SEQ ID NO: 17661 - RNA, 22 nt, Artificial Sequence
  Guide Sequence
agcccaggcuccaggaggguaa

SEQ ID NO: 17662 - RNA, 22 nt, Artificial Sequence
  Guide Sequence
agccccucaggccccuccuauc

SEQ ID NO: 17663 - RNA, 22 nt, Artificial Sequence
  Guide Sequence
agccuugaggcccggucaucaa

SEQ ID NO: 17664 - RNA, 22 nt, Artificial Sequence
  Guide Sequence
agcgacuaucugcuuucauuag

SEQ ID NO: 17665 - RNA, 22 nt, Artificial Sequence
  Guide Sequence
agcuguuuacacacaaggaauu

SEQ ID NO: 17666 - RNA, 22 nt, Artificial Sequence
  Guide Sequence
aggaauuguuuaccugagaccu

SEQ ID NO: 17667 - RNA, 22 nt, Artificial Sequence
  Guide Sequence
aggagagggggcugucaguuuc

SEQ ID NO: 17668 - RNA, 22 nt, Artificial Sequence
  Guide Sequence
aggaggggauucugcagaaaag

SEQ ID NO: 17669 - RNA, 22 nt, Artificial Sequence
  Guide Sequence
aggaggguaauuuagcgacuau

SEQ ID NO: 17670 - RNA, 22 nt, Artificial Sequence
  Guide Sequence
aggcaggaggggauucugcaga

SEQ ID NO: 17671 - RNA, 22 nt, Artificial Sequence
  Guide Sequence
aggcaggcaggaggggauucug

SEQ ID NO: 17672 - RNA, 22 nt, Artificial Sequence
  Guide Sequence
aggccccuccuaucagaggcag

SEQ ID NO: 17673 - RNA, 22 nt, Artificial Sequence
  Guide Sequence
aggcccggucaucaauucccca

SEQ ID NO: 17674 - RNA, 22 nt, Artificial Sequence
  Guide Sequence
aggcuccaggaggguaauuuag

SEQ ID NO: 17675 - RNA, 22 nt, Artificial Sequence
  Guide Sequence
agggcuguuugucaaggaagag

SEQ ID NO: 17676 - RNA, 22 nt, Artificial Sequence
  Guide Sequence
aggggauucugcagaaaagcaa

SEQ ID NO: 17677 - RNA, 22 nt, Artificial Sequence
  Guide Sequence
agggggcugcauugauggagua

SEQ ID NO: 17678 - RNA, 22 nt, Artificial Sequence
  Guide Sequence
agggggcugucaguuucugggu

SEQ ID NO: 17679 - RNA, 22 nt, Artificial Sequence
  Guide Sequence
aggguaauuuagcgacuaucug

SEQ ID NO: 17680 - RNA, 22 nt, Artificial Sequence
  Guide Sequence
agggugcagggcuguuugucaa

SEQ ID NO: 17681 - RNA, 22 nt, Artificial Sequence
  Guide Sequence
aguaaccacuaaagaaguuggc

SEQ ID NO: 17682 - RNA, 22 nt, Artificial Sequence
  Guide Sequence
aguagccuugaggcccggucau

SEQ ID NO: 17683 - RNA, 22 nt, Artificial Sequence
  Guide Sequence
agucugcccagccccucaggcc

SEQ ID NO: 17684 - RNA, 22 nt, Artificial Sequence
  Guide Sequence
agugagaauuagcuguuuacac

SEQ ID NO: 17685 - RNA, 22 nt, Artificial Sequence
  Guide Sequence
agugcccacccagggugcaggg

SEQ ID NO: 17686 - RNA, 22 nt, Artificial Sequence
  Guide Sequence
aguguguguuuucaguuucccu

SEQ ID NO: 17687 - RNA, 22 nt, Artificial Sequence
  Guide Sequence
aguuggcccuggagaugguggg

SEQ ID NO: 17688 - RNA, 22 nt, Artificial Sequence
  Guide Sequence
aguuucccuucuuauaaaacag

SEQ ID NO: 17689 - RNA, 22 nt, Artificial Sequence
  Guide Sequence
aguuucuggguguuagugugug

SEQ ID NO: 17690 - RNA, 22 nt, Artificial Sequence
  Guide Sequence
auaaaacagugagaauuagcug

SEQ ID NO: 17691 - RNA, 22 nt, Artificial Sequence
  Guide Sequence
auaguaaccacuaaagaaguug

SEQ ID NO: 17692 - RNA, 22 nt, Artificial Sequence
  Guide Sequence
auagucugcccagccccucagg

SEQ ID NO: 17693 - RNA, 22 nt, Artificial Sequence
  Guide Sequence
aucaagacccuuaaaucucccu

SEQ ID NO: 17694 - RNA, 22 nt, Artificial Sequence
  Guide Sequence
aucaauuccccaacgaaugguc

SEQ ID NO: 17695 - RNA, 22 nt, Artificial Sequence
  Guide Sequence
aucagaggcaggcaggagggga

SEQ ID NO: 17696 - RNA, 22 nt, Artificial Sequence
  Guide Sequence
aucugcuuucauuagccugcuc

SEQ ID NO: 17697 - RNA, 22 nt, Artificial Sequence
  Guide Sequence
auggaguagccuugaggcccgg

SEQ ID NO: 17698 - RNA, 22 nt, Artificial Sequence
  Guide Sequence
augguccugcauagucugccca

SEQ ID NO: 17699 - RNA, 22 nt, Artificial Sequence
  Guide Sequence
auggugggagugcccacccagg

SEQ ID NO: 17700 - RNA, 22 nt, Artificial Sequence
  Guide Sequence
auuagcuguuuacacacaagga

SEQ ID NO: 17701 - RNA, 22 nt, Artificial Sequence
  Guide Sequence
auuccccaacgaaugguccugc

SEQ ID NO: 17702 - RNA, 22 nt, Artificial Sequence
  Guide Sequence
auucugcagaaaagcaaacagc

SEQ ID NO: 17703 - RNA, 22 nt, Artificial Sequence
  Guide Sequence
auugauggaguagccuugaggc

SEQ ID NO: 17704 - RNA, 22 nt, Artificial Sequence
  Guide Sequence
auuguuuaccugagaccuugau

SEQ ID NO: 17705 - RNA, 22 nt, Artificial Sequence
  Guide Sequence
auuuagcgacuaucugcuuuca

SEQ ID NO: 17706 - RNA, 22 nt, Artificial Sequence
  Guide Sequence
caaacagcacggggccucaccc

SEQ ID NO: 17707 - RNA, 22 nt, Artificial Sequence
  Guide Sequence
caacgaaugguccugcauaguc

SEQ ID NO: 17708 - RNA, 22 nt, Artificial Sequence
  Guide Sequence
caagacccuuaaaucucccucu

SEQ ID NO: 17709 - RNA, 22 nt, Artificial Sequence
  Guide Sequence
caaggaagagcuagccgggggg

SEQ ID NO: 17710 - RNA, 22 nt, Artificial Sequence
  Guide Sequence
caaggaauuguuuaccugagac

SEQ ID NO: 17711 - RNA, 22 nt, Artificial Sequence
  Guide Sequence
caauuccccaacgaaugguccu

SEQ ID NO: 17712 - RNA, 22 nt, Artificial Sequence
  Guide Sequence
cacaaggaauuguuuaccugag

SEQ ID NO: 17713 - RNA, 22 nt, Artificial Sequence
  Guide Sequence
cacacaaggaauuguuuaccug

SEQ ID NO: 17714 - RNA, 22 nt, Artificial Sequence
  Guide Sequence
cacccagggugcagggcuguuu

SEQ ID NO: 17715 - RNA, 22 nt, Artificial Sequence
  Guide Sequence
caccccgaccucucuggcugac

SEQ ID NO: 17716 - RNA, 22 nt, Artificial Sequence
  Guide Sequence
cacggggccucaccccgaccuc

SEQ ID NO: 17717 - RNA, 22 nt, Artificial Sequence
  Guide Sequence
cacuaaagaaguuggcccugga

SEQ ID NO: 17718 - RNA, 22 nt, Artificial Sequence
  Guide Sequence
cagaaaagcaaacagcacgggg

SEQ ID NO: 17719 - RNA, 22 nt, Artificial Sequence
  Guide Sequence
cagaggcaggcaggaggggauu

SEQ ID NO: 17720 - RNA, 22 nt, Artificial Sequence
  Guide Sequence
cagcacggggccucaccccgac

SEQ ID NO: 17721 - RNA, 22 nt, Artificial Sequence
  Guide Sequence
cagccccucaggccccuccuau

SEQ ID NO: 17722 - RNA, 22 nt, Artificial Sequence
  Guide Sequence
caggaggggauucugcagaaaa

SEQ ID NO: 17723 - RNA, 22 nt, Artificial Sequence
  Guide Sequence
caggaggguaauuuagcgacua

SEQ ID NO: 17724 - RNA, 22 nt, Artificial Sequence
  Guide Sequence
caggcaggaggggauucugcag

SEQ ID NO: 17725 - RNA, 22 nt, Artificial Sequence
  Guide Sequence
caggccccuccuaucagaggca

SEQ ID NO: 17726 - RNA, 22 nt, Artificial Sequence
  Guide Sequence
caggcuccaggaggguaauuua

SEQ ID NO: 17727 - RNA, 22 nt, Artificial Sequence
  Guide Sequence
cagggcuguuugucaaggaaga

SEQ ID NO: 17728 - RNA, 22 nt, Artificial Sequence
  Guide Sequence
cagggugcagggcuguuuguca

SEQ ID NO: 17729 - RNA, 22 nt, Artificial Sequence
  Guide Sequence
cagugagaauuagcuguuuaca

SEQ ID NO: 17730 - RNA, 22 nt, Artificial Sequence
  Guide Sequence
caguuucccuucuuauaaaaca

SEQ ID NO: 17731 - RNA, 22 nt, Artificial Sequence
  Guide Sequence
caguuucuggguguuagugugu

SEQ ID NO: 17732 - RNA, 22 nt, Artificial Sequence
  Guide Sequence
cauagucugcccagccccucag

SEQ ID NO: 17733 - RNA, 22 nt, Artificial Sequence
  Guide Sequence
caucaauuccccaacgaauggu

SEQ ID NO: 17734 - RNA, 22 nt, Artificial Sequence
  Guide Sequence
cauuagccugcucguuaacuuu

SEQ ID NO: 17735 - RNA, 22 nt, Artificial Sequence
  Guide Sequence
cauugauggaguagccuugagg

SEQ ID NO: 17736 - RNA, 22 nt, Artificial Sequence
  Guide Sequence
ccaacgaaugguccugcauagu

SEQ ID NO: 17737 - RNA, 22 nt, Artificial Sequence
  Guide Sequence
ccacccagggugcagggcuguu

SEQ ID NO: 17738 - RNA, 22 nt, Artificial Sequence
  Guide Sequence
ccacuaaagaaguuggcccugg

SEQ ID NO: 17739 - RNA, 22 nt, Artificial Sequence
  Guide Sequence
ccagccccucaggccccuccua

SEQ ID NO: 17740 - RNA, 22 nt, Artificial Sequence
  Guide Sequence
ccaggaggguaauuuagcgacu

SEQ ID NO: 17741 - RNA, 22 nt, Artificial Sequence
  Guide Sequence
ccaggcuccaggaggguaauuu

SEQ ID NO: 17742 - RNA, 22 nt, Artificial Sequence
  Guide Sequence
ccagggugcagggcuguuuguc

SEQ ID NO: 17743 - RNA, 22 nt, Artificial Sequence
  Guide Sequence
cccaacgaaugguccugcauag

SEQ ID NO: 17744 - RNA, 22 nt, Artificial Sequence
  Guide Sequence
cccacccagggugcagggcugu

SEQ ID NO: 17745 - RNA, 22 nt, Artificial Sequence
  Guide Sequence
cccagccccucaggccccuccu

SEQ ID NO: 17746 - RNA, 22 nt, Artificial Sequence
  Guide Sequence
cccaggcuccaggaggguaauu

SEQ ID NO: 17747 - RNA, 22 nt, Artificial Sequence
  Guide Sequence
cccagggugcagggcuguuugu

SEQ ID NO: 17748 - RNA, 22 nt, Artificial Sequence
  Guide Sequence
ccccaacgaaugguccugcaua

SEQ ID NO: 17749 - RNA, 22 nt, Artificial Sequence
  Guide Sequence
ccccgaccucucuggcugacua

SEQ ID NO: 17750 - RNA, 22 nt, Artificial Sequence
  Guide Sequence
ccccucaggccccuccuaucag

SEQ ID NO: 17751 - RNA, 22 nt, Artificial Sequence
  Guide Sequence
ccccuccuaucagaggcaggca

SEQ ID NO: 17752 - RNA, 22 nt, Artificial Sequence
  Guide Sequence
cccgaccucucuggcugacuag

SEQ ID NO: 17753 - RNA, 22 nt, Artificial Sequence
  Guide Sequence
cccggucaucaauuccccaacg

SEQ ID NO: 17754 - RNA, 22 nt, Artificial Sequence
  Guide Sequence
cccucaggccccuccuaucaga

SEQ ID NO: 17755 - RNA, 22 nt, Artificial Sequence
  Guide Sequence
cccuccuaucagaggcaggcag

SEQ ID NO: 17756 - RNA, 22 nt, Artificial Sequence
  Guide Sequence
cccuggagauggugggagugcc

SEQ ID NO: 17757 - RNA, 22 nt, Artificial Sequence
  Guide Sequence
cccuuaaaucucccucucacac

SEQ ID NO: 17758 - RNA, 22 nt, Artificial Sequence
  Guide Sequence
cccuucuuauaaaacagugaga

SEQ ID NO: 17759 - RNA, 22 nt, Artificial Sequence
  Guide Sequence
ccgaccucucuggcugacuagc

SEQ ID NO: 17760 - RNA, 22 nt, Artificial Sequence
  Guide Sequence
ccggucaucaauuccccaacga

SEQ ID NO: 17761 - RNA, 22 nt, Artificial Sequence
  Guide Sequence
ccuaucagaggcaggcaggagg

SEQ ID NO: 17762 - RNA, 22 nt, Artificial Sequence
  Guide Sequence
ccucaccccgaccucucuggcu

SEQ ID NO: 17763 - RNA, 22 nt, Artificial Sequence
  Guide Sequence
ccucaggccccuccuaucagag

SEQ ID NO: 17764 - RNA, 22 nt, Artificial Sequence
  Guide Sequence
ccuccuaucagaggcaggcagg

SEQ ID NO: 17765 - RNA, 22 nt, Artificial Sequence
  Guide Sequence
ccucucuggcugacuagcccag

SEQ ID NO: 17766 - RNA, 22 nt, Artificial Sequence
  Guide Sequence
ccugagaccuugaucaagaccc

SEQ ID NO: 17767 - RNA, 22 nt, Artificial Sequence
  Guide Sequence
ccugcauagucugcccagcccc

SEQ ID NO: 17768 - RNA, 22 nt, Artificial Sequence
  Guide Sequence
ccuggagauggugggagugccc

SEQ ID NO: 17769 - RNA, 22 nt, Artificial Sequence
  Guide Sequence
ccuuaaaucucccucucacacu

SEQ ID NO: 17770 - RNA, 22 nt, Artificial Sequence
  Guide Sequence
ccuucuuauaaaacagugagaa

SEQ ID NO: 17771 - RNA, 22 nt, Artificial Sequence
  Guide Sequence
ccuugaggcccggucaucaauu

SEQ ID NO: 17772 - RNA, 22 nt, Artificial Sequence
  Guide Sequence
ccuugaucaagacccuuaaauc

SEQ ID NO: 17773 - RNA, 22 nt, Artificial Sequence
  Guide Sequence
cgaaugguccugcauagucugc

SEQ ID NO: 17774 - RNA, 22 nt, Artificial Sequence
  Guide Sequence
cgaccucucuggcugacuagcc

SEQ ID NO: 17775 - RNA, 22 nt, Artificial Sequence
  Guide Sequence
cgacuaucugcuuucauuagcc

SEQ ID NO: 17776 - RNA, 22 nt, Artificial Sequence
  Guide Sequence
cggggccucaccccgaccucuc

SEQ ID NO: 17777 - RNA, 22 nt, Artificial Sequence
  Guide Sequence
cggucaucaauuccccaacgaa

SEQ ID NO: 17778 - RNA, 22 nt, Artificial Sequence
  Guide Sequence
cuaaagaaguuggcccuggaga

SEQ ID NO: 17779 - RNA, 22 nt, Artificial Sequence
  Guide Sequence
cuagcccaggcuccaggagggu

SEQ ID NO: 17780 - RNA, 22 nt, Artificial Sequence
  Guide Sequence
cuaucagaggcaggcaggaggg

SEQ ID NO: 17781 - RNA, 22 nt, Artificial Sequence
  Guide Sequence
cuaucugcuuucauuagccugc

SEQ ID NO: 17782 - RNA, 22 nt, Artificial Sequence
  Guide Sequence
cucaccccgaccucucuggcug

SEQ ID NO: 17783 - RNA, 22 nt, Artificial Sequence
  Guide Sequence
cucaggccccuccuaucagagg

SEQ ID NO: 17784 - RNA, 22 nt, Artificial Sequence
  Guide Sequence
cuccaggaggguaauuuagcga

SEQ ID NO: 17785 - RNA, 22 nt, Artificial Sequence
  Guide Sequence
cuccuaucagaggcaggcagga

SEQ ID NO: 17786 - RNA, 22 nt, Artificial Sequence
  Guide Sequence
cucucuggcugacuagcccagg

SEQ ID NO: 17787 - RNA, 22 nt, Artificial Sequence
  Guide Sequence
cucuggcugacuagcccaggcu

SEQ ID NO: 17788 - RNA, 22 nt, Artificial Sequence
  Guide Sequence
cugacuagcccaggcuccagga

SEQ ID NO: 17789 - RNA, 22 nt, Artificial Sequence
  Guide Sequence
cugagaccuugaucaagacccu

SEQ ID NO: 17790 - RNA, 22 nt, Artificial Sequence
  Guide Sequence
cugcagaaaagcaaacagcacg

SEQ ID NO: 17791 - RNA, 22 nt, Artificial Sequence
  Guide Sequence
cugcauagucugcccagccccu

SEQ ID NO: 17792 - RNA, 22 nt, Artificial Sequence
  Guide Sequence
cugcauugauggaguagccuug

SEQ ID NO: 17793 - RNA, 22 nt, Artificial Sequence
  Guide Sequence
cugcccagccccucaggccccu

SEQ ID NO: 17794 - RNA, 22 nt, Artificial Sequence
  Guide Sequence
cugcuuucauuagccugcucgu

SEQ ID NO: 17795 - RNA, 22 nt, Artificial Sequence
  Guide Sequence
cuggagauggugggagugccca

SEQ ID NO: 17796 - RNA, 22 nt, Artificial Sequence
  Guide Sequence
cuggcugacuagcccaggcucc

SEQ ID NO: 17797 - RNA, 22 nt, Artificial Sequence
  Guide Sequence
cuggguguuaguguguguuuuc

SEQ ID NO: 17798 - RNA, 22 nt, Artificial Sequence
  Guide Sequence
cugucaguuucuggguguuagu

SEQ ID NO: 17799 - RNA, 22 nt, Artificial Sequence
  Guide Sequence
cuguuuacacacaaggaauugu

SEQ ID NO: 17800 - RNA, 22 nt, Artificial Sequence
  Guide Sequence
cuguuugucaaggaagagcuag

SEQ ID NO: 17801 - RNA, 22 nt, Artificial Sequence
  Guide Sequence
cuuaaaucucccucucacacua

SEQ ID NO: 17802 - RNA, 22 nt, Artificial Sequence
  Guide Sequence
cuugaggcccggucaucaauuc

SEQ ID NO: 17803 - RNA, 22 nt, Artificial Sequence
  Guide Sequence
cuugaucaagacccuuaaaucu

SEQ ID NO: 17804 - RNA, 22 nt, Artificial Sequence
  Guide Sequence
cuuucauuagccugcucguuaa

SEQ ID NO: 17805 - RNA, 22 nt, Artificial Sequence
  Guide Sequence
gaaaagcaaacagcacggggcc

SEQ ID NO: 17806 - RNA, 22 nt, Artificial Sequence
  Guide Sequence
gaaguuggcccuggagauggug

SEQ ID NO: 17807 - RNA, 22 nt, Artificial Sequence
  Guide Sequence
gaaugguccugcauagucugcc

SEQ ID NO: 17808 - RNA, 22 nt, Artificial Sequence
  Guide Sequence
gaauuagcuguuuacacacaag

SEQ ID NO: 17809 - RNA, 22 nt, Artificial Sequence
  Guide Sequence
gaauuguuuaccugagaccuug

SEQ ID NO: 17810 - RNA, 22 nt, Artificial Sequence
  Guide Sequence
gacccuuaaaucucccucucac

SEQ ID NO: 17811 - RNA, 22 nt, Artificial Sequence
  Guide Sequence
gaccucucuggcugacuagccc

SEQ ID NO: 17812 - RNA, 22 nt, Artificial Sequence
  Guide Sequence
gaccuugaucaagacccuuaaa

SEQ ID NO: 17813 - RNA, 22 nt, Artificial Sequence
  Guide Sequence
gacuagcccaggcuccaggagg

SEQ ID NO: 17814 - RNA, 22 nt, Artificial Sequence
  Guide Sequence
gacuaucugcuuucauuagccu

SEQ ID NO: 17815 - RNA, 22 nt, Artificial Sequence
  Guide Sequence
gagaauuagcuguuuacacaca

SEQ ID NO: 17816 - RNA, 22 nt, Artificial Sequence
  Guide Sequence
gagaccuugaucaagacccuua

SEQ ID NO: 17817 - RNA, 22 nt, Artificial Sequence
  Guide Sequence
gagagggggcugucaguuucug

SEQ ID NO: 17818 - RNA, 22 nt, Artificial Sequence
  Guide Sequence
gagauggugggagugcccaccc

SEQ ID NO: 17819 - RNA, 22 nt, Artificial Sequence
  Guide Sequence
gaggagagggggcugucaguuu

SEQ ID NO: 17820 - RNA, 22 nt, Artificial Sequence
  Guide Sequence
gaggcaggcaggaggggauucu

SEQ ID NO: 17821 - RNA, 22 nt, Artificial Sequence
  Guide Sequence
gaggcccggucaucaauucccc

SEQ ID NO: 17822 - RNA, 22 nt, Artificial Sequence
  Guide Sequence
gaggggauucugcagaaaagca

SEQ ID NO: 17823 - RNA, 22 nt, Artificial Sequence
  Guide Sequence
gagggggcugucaguuucuggg

SEQ ID NO: 17824 - RNA, 22 nt, Artificial Sequence
  Guide Sequence
gaggguaauuuagcgacuaucu

SEQ ID NO: 17825 - RNA, 22 nt, Artificial Sequence
  Guide Sequence
gaguagccuugaggcccgguca

SEQ ID NO: 17826 - RNA, 22 nt, Artificial Sequence
  Guide Sequence
gagugcccacccagggugcagg

SEQ ID NO: 17827 - RNA, 22 nt, Artificial Sequence
  Guide Sequence
gauaguaaccacuaaagaaguu

SEQ ID NO: 17828 - RNA, 22 nt, Artificial Sequence
  Guide Sequence
gaucaagacccuuaaaucuccc

SEQ ID NO: 17829 - RNA, 22 nt, Artificial Sequence
  Guide Sequence
gauggaguagccuugaggcccg

SEQ ID NO: 17830 - RNA, 22 nt, Artificial Sequence
  Guide Sequence
gauggugggagugcccacccag

SEQ ID NO: 17831 - RNA, 22 nt, Artificial Sequence
  Guide Sequence
gauucugcagaaaagcaaacag

SEQ ID NO: 17832 - RNA, 22 nt, Artificial Sequence
  Guide Sequence
gcaaacagcacggggccucacc

SEQ ID NO: 17833 - RNA, 22 nt, Artificial Sequence
  Guide Sequence
gcacggggccucaccccgaccu

SEQ ID NO: 17834 - RNA, 22 nt, Artificial Sequence
  Guide Sequence
gcagaaaagcaaacagcacggg

SEQ ID NO: 17835 - RNA, 22 nt, Artificial Sequence
  Guide Sequence
gcaggaggggauucugcagaaa

SEQ ID NO: 17836 - RNA, 22 nt, Artificial Sequence
  Guide Sequence
gcaggcaggaggggauucugca

SEQ ID NO: 17837 - RNA, 22 nt, Artificial Sequence
  Guide Sequence
gcagggcuguuugucaaggaag

SEQ ID NO: 17838 - RNA, 22 nt, Artificial Sequence
  Guide Sequence
gcauagucugcccagccccuca

SEQ ID NO: 17839 - RNA, 22 nt, Artificial Sequence
  Guide Sequence
gcauugauggaguagccuugag

SEQ ID NO: 17840 - RNA, 22 nt, Artificial Sequence
  Guide Sequence
gcccacccagggugcagggcug

SEQ ID NO: 17841 - RNA, 22 nt, Artificial Sequence
  Guide Sequence
gcccaggcuccaggaggguaau

SEQ ID NO: 17842 - RNA, 22 nt, Artificial Sequence
  Guide Sequence
gccccucaggccccuccuauca

SEQ ID NO: 17843 - RNA, 22 nt, Artificial Sequence
  Guide Sequence
gccccuccuaucagaggcaggc

SEQ ID NO: 17844 - RNA, 22 nt, Artificial Sequence
  Guide Sequence
gcccggucaucaauuccccaac

SEQ ID NO: 17845 - RNA, 22 nt, Artificial Sequence
  Guide Sequence
gcccuggagauggugggagugc

SEQ ID NO: 17846 - RNA, 22 nt, Artificial Sequence
  Guide Sequence
gccucaccccgaccucucuggc

SEQ ID NO: 17847 - RNA, 22 nt, Artificial Sequence
  Guide Sequence
gccuugaggcccggucaucaau

SEQ ID NO: 17848 - RNA, 22 nt, Artificial Sequence
  Guide Sequence
gcgacuaucugcuuucauuagc

SEQ ID NO: 17849 - RNA, 22 nt, Artificial Sequence
  Guide Sequence
gcuccaggaggguaauuuagcg

SEQ ID NO: 17850 - RNA, 22 nt, Artificial Sequence
  Guide Sequence
gcugacuagcccaggcuccagg

SEQ ID NO: 17851 - RNA, 22 nt, Artificial Sequence
  Guide Sequence
gcugcauugauggaguagccuu

SEQ ID NO: 17852 - RNA, 22 nt, Artificial Sequence
  Guide Sequence
gcugucaguuucuggguguuag

SEQ ID NO: 17853 - RNA, 22 nt, Artificial Sequence
  Guide Sequence
gcuguuuacacacaaggaauug

SEQ ID NO: 17854 - RNA, 22 nt, Artificial Sequence
  Guide Sequence
gcuguuugucaaggaagagcua

SEQ ID NO: 17855 - RNA, 22 nt, Artificial Sequence
  Guide Sequence
gcuuucauuagccugcucguua

SEQ ID NO: 17856 - RNA, 22 nt, Artificial Sequence
  Guide Sequence
ggaauuguuuaccugagaccuu

SEQ ID NO: 17857 - RNA, 22 nt, Artificial Sequence
  Guide Sequence
ggagagggggcugucaguuucu

SEQ ID NO: 17858 - RNA, 22 nt, Artificial Sequence
  Guide Sequence
ggagauggugggagugcccacc

SEQ ID NO: 17859 - RNA, 22 nt, Artificial Sequence
  Guide Sequence
ggaggggauucugcagaaaagc

SEQ ID NO: 17860 - RNA, 22 nt, Artificial Sequence
  Guide Sequence
ggaggguaauuuagcgacuauc

SEQ ID NO: 17861 - RNA, 22 nt, Artificial Sequence
  Guide Sequence
ggaguagccuugaggcccgguc

SEQ ID NO: 17862 - RNA, 22 nt, Artificial Sequence
  Guide Sequence
ggagugcccacccagggugcag

SEQ ID NO: 17863 - RNA, 22 nt, Artificial Sequence
  Guide Sequence
ggauaguaaccacuaaagaagu

SEQ ID NO: 17864 - RNA, 22 nt, Artificial Sequence
  Guide Sequence
ggauucugcagaaaagcaaaca

SEQ ID NO: 17865 - RNA, 22 nt, Artificial Sequence
  Guide Sequence
ggcaggaggggauucugcagaa

SEQ ID NO: 17866 - RNA, 22 nt, Artificial Sequence
  Guide Sequence
ggcaggcaggaggggauucugc

SEQ ID NO: 17867 - RNA, 22 nt, Artificial Sequence
  Guide Sequence
ggccccuccuaucagaggcagg

SEQ ID NO: 17868 - RNA, 22 nt, Artificial Sequence
  Guide Sequence
ggcccggucaucaauuccccaa

SEQ ID NO: 17869 - RNA, 22 nt, Artificial Sequence
  Guide Sequence
ggcccuggagauggugggagug

SEQ ID NO: 17870 - RNA, 22 nt, Artificial Sequence
  Guide Sequence
ggccucaccccgaccucucugg

SEQ ID NO: 17871 - RNA, 22 nt, Artificial Sequence
  Guide Sequence
ggcuccaggaggguaauuuagc

SEQ ID NO: 17872 - RNA, 22 nt, Artificial Sequence
  Guide Sequence
ggcugacuagcccaggcuccag

SEQ ID NO: 17873 - RNA, 22 nt, Artificial Sequence
  Guide Sequence
ggcugcauugauggaguagccu

SEQ ID NO: 17874 - RNA, 22 nt, Artificial Sequence
  Guide Sequence
ggcugucaguuucuggguguua

SEQ ID NO: 17875 - RNA, 22 nt, Artificial Sequence
  Guide Sequence
ggcuguuugucaaggaagagcu

SEQ ID NO: 17876 - RNA, 22 nt, Artificial Sequence
  Guide Sequence
gggagugcccacccagggugca

SEQ ID NO: 17877 - RNA, 22 nt, Artificial Sequence
  Guide Sequence
gggauaguaaccacuaaagaag

SEQ ID NO: 17878 - RNA, 22 nt, Artificial Sequence
  Guide Sequence
gggauucugcagaaaagcaaac

SEQ ID NO: 17879 - RNA, 22 nt, Artificial Sequence
  Guide Sequence
gggccucaccccgaccucucug

SEQ ID NO: 17880 - RNA, 22 nt, Artificial Sequence
  Guide Sequence
gggcugcauugauggaguagcc

SEQ ID NO: 17881 - RNA, 22 nt, Artificial Sequence
  Guide Sequence
gggcugucaguuucuggguguu

SEQ ID NO: 17882 - RNA, 22 nt, Artificial Sequence
  Guide Sequence
gggcuguuugucaaggaagagc

SEQ ID NO: 17883 - RNA, 22 nt, Artificial Sequence
  Guide Sequence
ggggauucugcagaaaagcaaa

SEQ ID NO: 17884 - RNA, 22 nt, Artificial Sequence
  Guide Sequence
ggggccucaccccgaccucucu

SEQ ID NO: 17885 - RNA, 22 nt, Artificial Sequence
  Guide Sequence
ggggcugcauugauggaguagc

SEQ ID NO: 17886 - RNA, 22 nt, Artificial Sequence
  Guide Sequence
ggggcugucaguuucugggugu

SEQ ID NO: 17887 - RNA, 22 nt, Artificial Sequence
  Guide Sequence
gggggcugcauugauggaguag

SEQ ID NO: 17888 - RNA, 22 nt, Artificial Sequence
  Guide Sequence
gggggcugucaguuucugggug

SEQ ID NO: 17889 - RNA, 22 nt, Artificial Sequence
  Guide Sequence
ggggggugggugaggagagggg

SEQ ID NO: 17890 - RNA, 22 nt, Artificial Sequence
  Guide Sequence
gggggugggugaggagaggggg

SEQ ID NO: 17891 - RNA, 22 nt, Artificial Sequence
  Guide Sequence
ggggugggugaggagagggggc

SEQ ID NO: 17892 - RNA, 22 nt, Artificial Sequence
  Guide Sequence
ggguaauuuagcgacuaucugc

SEQ ID NO: 17893 - RNA, 22 nt, Artificial Sequence
  Guide Sequence
gggugaggagagggggcuguca

SEQ ID NO: 17894 - RNA, 22 nt, Artificial Sequence
  Guide Sequence
gggugcagggcuguuugucaag

SEQ ID NO: 17895 - RNA, 22 nt, Artificial Sequence
  Guide Sequence
gggugggugaggagagggggcu

SEQ ID NO: 17896 - RNA, 22 nt, Artificial Sequence
  Guide Sequence
ggguguuaguguguguuuucag

SEQ ID NO: 17897 - RNA, 22 nt, Artificial Sequence
  Guide Sequence
gguaauuuagcgacuaucugcu

SEQ ID NO: 17898 - RNA, 22 nt, Artificial Sequence
  Guide Sequence
ggucaucaauuccccaacgaau

SEQ ID NO: 17899 - RNA, 22 nt, Artificial Sequence
  Guide Sequence
gguccugcauagucugcccagc

SEQ ID NO: 17900 - RNA, 22 nt, Artificial Sequence
  Guide Sequence
ggugaggagagggggcugucag

SEQ ID NO: 17901 - RNA, 22 nt, Artificial Sequence
  Guide Sequence
ggugcagggcuguuugucaagg

SEQ ID NO: 17902 - RNA, 22 nt, Artificial Sequence
  Guide Sequence
ggugggagugcccacccagggu

SEQ ID NO: 17903 - RNA, 22 nt, Artificial Sequence
  Guide Sequence
ggugggugaggagagggggcug

SEQ ID NO: 17904 - RNA, 22 nt, Artificial Sequence
  Guide Sequence
gguguuaguguguguuuucagu

SEQ ID NO: 17905 - RNA, 22 nt, Artificial Sequence
  Guide Sequence
guaaccacuaaagaaguuggcc

SEQ ID NO: 17906 - RNA, 22 nt, Artificial Sequence
  Guide Sequence
guaauuuagcgacuaucugcuu

SEQ ID NO: 17907 - RNA, 22 nt, Artificial Sequence
  Guide Sequence
guagccuugaggcccggucauc

SEQ ID NO: 17908 - RNA, 22 nt, Artificial Sequence
  Guide Sequence
gucaaggaagagcuagccgggg

SEQ ID NO: 17909 - RNA, 22 nt, Artificial Sequence
  Guide Sequence
gucaguuucuggguguuagugu

SEQ ID NO: 17910 - RNA, 22 nt, Artificial Sequence
  Guide Sequence
gucaucaauuccccaacgaaug

SEQ ID NO: 17911 - RNA, 22 nt, Artificial Sequence
  Guide Sequence
guccugcauagucugcccagcc

SEQ ID NO: 17912 - RNA, 22 nt, Artificial Sequence
  Guide Sequence
gucugcccagccccucaggccc

SEQ ID NO: 17913 - RNA, 22 nt, Artificial Sequence
  Guide Sequence
gugagaauuagcuguuuacaca

SEQ ID NO: 17914 - RNA, 22 nt, Artificial Sequence
  Guide Sequence
gugaggagagggggcugucagu

SEQ ID NO: 17915 - RNA, 22 nt, Artificial Sequence
  Guide Sequence
gugcagggcuguuugucaagga

SEQ ID NO: 17916 - RNA, 22 nt, Artificial Sequence
  Guide Sequence
gugcccacccagggugcagggc

SEQ ID NO: 17917 - RNA, 22 nt, Artificial Sequence
  Guide Sequence
gugggagugcccacccagggug

SEQ ID NO: 17918 - RNA, 22 nt, Artificial Sequence
  Guide Sequence
gugggugaggagagggggcugu

SEQ ID NO: 17919 - RNA, 22 nt, Artificial Sequence
  Guide Sequence
guguguguuuucaguuucccuu

SEQ ID NO: 17920 - RNA, 22 nt, Artificial Sequence
  Guide Sequence
guguguuuucaguuucccuucu

SEQ ID NO: 17921 - RNA, 22 nt, Artificial Sequence
  Guide Sequence
guguuaguguguguuuucaguu

SEQ ID NO: 17922 - RNA, 22 nt, Artificial Sequence
  Guide Sequence
guguuuucaguuucccuucuua

SEQ ID NO: 17923 - RNA, 22 nt, Artificial Sequence
  Guide Sequence
guuaguguguguuuucaguuuc

SEQ ID NO: 17924 - RNA, 22 nt, Artificial Sequence
  Guide Sequence
guuggcccuggagaugguggga

SEQ ID NO: 17925 - RNA, 22 nt, Artificial Sequence
  Guide Sequence
guuuacacacaaggaauuguuu

SEQ ID NO: 17926 - RNA, 22 nt, Artificial Sequence
  Guide Sequence
guuuaccugagaccuugaucaa

SEQ ID NO: 17927 - RNA, 22 nt, Artificial Sequence
  Guide Sequence
guuucccuucuuauaaaacagu

SEQ ID NO: 17928 - RNA, 22 nt, Artificial Sequence
  Guide Sequence
guuucuggguguuagugugugu

SEQ ID NO: 17929 - RNA, 22 nt, Artificial Sequence
  Guide Sequence
guuugucaaggaagagcuagcc

SEQ ID NO: 17930 - RNA, 22 nt, Artificial Sequence
  Guide Sequence
guuuucaguuucccuucuuaua

SEQ ID NO: 17931 - RNA, 22 nt, Artificial Sequence
  Guide Sequence
uaaaacagugagaauuagcugu

SEQ ID NO: 17932 - RNA, 22 nt, Artificial Sequence
  Guide Sequence
uaaagaaguuggcccuggagau

SEQ ID NO: 17933 - RNA, 22 nt, Artificial Sequence
  Guide Sequence
uaaccacuaaagaaguuggccc

SEQ ID NO: 17934 - RNA, 22 nt, Artificial Sequence
  Guide Sequence
uaauuuagcgacuaucugcuuu

SEQ ID NO: 17935 - RNA, 22 nt, Artificial Sequence
  Guide Sequence
uacacacaaggaauuguuuacc

SEQ ID NO: 17936 - RNA, 22 nt, Artificial Sequence
  Guide Sequence
uaccugagaccuugaucaagac

SEQ ID NO: 17937 - RNA, 22 nt, Artificial Sequence
  Guide Sequence
uagcccaggcuccaggagggua

SEQ ID NO: 17938 - RNA, 22 nt, Artificial Sequence
  Guide Sequence
uagccuugaggcccggucauca

SEQ ID NO: 17939 - RNA, 22 nt, Artificial Sequence
  Guide Sequence
uagcgacuaucugcuuucauua

SEQ ID NO: 17940 - RNA, 22 nt, Artificial Sequence
  Guide Sequence
uagcuguuuacacacaaggaau

SEQ ID NO: 17941 - RNA, 22 nt, Artificial Sequence
  Guide Sequence
uaguaaccacuaaagaaguugg

SEQ ID NO: 17942 - RNA, 22 nt, Artificial Sequence
  Guide Sequence
uagucugcccagccccucaggc

SEQ ID NO: 17943 - RNA, 22 nt, Artificial Sequence
  Guide Sequence
uaguguguguuuucaguuuccc

SEQ ID NO: 17944 - RNA, 22 nt, Artificial Sequence
  Guide Sequence
uaucagaggcaggcaggagggg

SEQ ID NO: 17945 - RNA, 22 nt, Artificial Sequence
  Guide Sequence
uaucugcuuucauuagccugcu

SEQ ID NO: 17946 - RNA, 22 nt, Artificial Sequence
  Guide Sequence
ucaagacccuuaaaucucccuc

SEQ ID NO: 17947 - RNA, 22 nt, Artificial Sequence
  Guide Sequence
ucaaggaagagcuagccggggg

SEQ ID NO: 17948 - RNA, 22 nt, Artificial Sequence
  Guide Sequence
ucaauuccccaacgaauggucc

SEQ ID NO: 17949 - RNA, 22 nt, Artificial Sequence
  Guide Sequence
ucaccccgaccucucuggcuga

SEQ ID NO: 17950 - RNA, 22 nt, Artificial Sequence
  Guide Sequence
ucagaggcaggcaggaggggau

SEQ ID NO: 17951 - RNA, 22 nt, Artificial Sequence
  Guide Sequence
ucaggccccuccuaucagaggc

SEQ ID NO: 17952 - RNA, 22 nt, Artificial Sequence
  Guide Sequence
ucaguuucccuucuuauaaaac

SEQ ID NO: 17953 - RNA, 22 nt, Artificial Sequence
  Guide Sequence
ucaguuucuggguguuagugug

SEQ ID NO: 17954 - RNA, 22 nt, Artificial Sequence
  Guide Sequence
ucaucaauuccccaacgaaugg

SEQ ID NO: 17955 - RNA, 22 nt, Artificial Sequence
  Guide Sequence
ucauuagccugcucguuaacuu

SEQ ID NO: 17956 - RNA, 22 nt, Artificial Sequence
  Guide Sequence
uccaggaggguaauuuagcgac

SEQ ID NO: 17957 - RNA, 22 nt, Artificial Sequence
  Guide Sequence
uccccaacgaaugguccugcau

SEQ ID NO: 17958 - RNA, 22 nt, Artificial Sequence
  Guide Sequence
ucccuucuuauaaaacagugag

SEQ ID NO: 17959 - RNA, 22 nt, Artificial Sequence
  Guide Sequence
uccuaucagaggcaggcaggag

SEQ ID NO: 17960 - RNA, 22 nt, Artificial Sequence
  Guide Sequence
uccugcauagucugcccagccc

SEQ ID NO: 17961 - RNA, 22 nt, Artificial Sequence
  Guide Sequence
ucucuggcugacuagcccaggc

SEQ ID NO: 17962 - RNA, 22 nt, Artificial Sequence
  Guide Sequence
ucugcagaaaagcaaacagcac

SEQ ID NO: 17963 - RNA, 22 nt, Artificial Sequence
  Guide Sequence
ucugcccagccccucaggcccc

SEQ ID NO: 17964 - RNA, 22 nt, Artificial Sequence
  Guide Sequence
ucugcuuucauuagccugcucg

SEQ ID NO: 17965 - RNA, 22 nt, Artificial Sequence
  Guide Sequence
ucuggcugacuagcccaggcuc

SEQ ID NO: 17966 - RNA, 22 nt, Artificial Sequence
  Guide Sequence
ucuggguguuaguguguguuuu

SEQ ID NO: 17967 - RNA, 22 nt, Artificial Sequence
  Guide Sequence
ugacuagcccaggcuccaggag

SEQ ID NO: 17968 - RNA, 22 nt, Artificial Sequence
  Guide Sequence
ugagaauuagcuguuuacacac

SEQ ID NO: 17969 - RNA, 22 nt, Artificial Sequence
  Guide Sequence
ugagaccuugaucaagacccuu

SEQ ID NO: 17970 - RNA, 22 nt, Artificial Sequence
  Guide Sequence
ugaggagagggggcugucaguu

SEQ ID NO: 17971 - RNA, 22 nt, Artificial Sequence
  Guide Sequence
ugaggcccggucaucaauuccc

SEQ ID NO: 17972 - RNA, 22 nt, Artificial Sequence
  Guide Sequence
ugaucaagacccuuaaaucucc

SEQ ID NO: 17973 - RNA, 22 nt, Artificial Sequence
  Guide Sequence
ugauggaguagccuugaggccc

SEQ ID NO: 17974 - RNA, 22 nt, Artificial Sequence
  Guide Sequence
ugcagaaaagcaaacagcacgg

SEQ ID NO: 17975 - RNA, 22 nt, Artificial Sequence
  Guide Sequence
ugcagggcuguuugucaaggaa

SEQ ID NO: 17976 - RNA, 22 nt, Artificial Sequence
  Guide Sequence
ugcauagucugcccagccccuc

SEQ ID NO: 17977 - RNA, 22 nt, Artificial Sequence
  Guide Sequence
ugcauugauggaguagccuuga

SEQ ID NO: 17978 - RNA, 22 nt, Artificial Sequence
  Guide Sequence
ugcccacccagggugcagggcu

SEQ ID NO: 17979 - RNA, 22 nt, Artificial Sequence
  Guide Sequence
ugcccagccccucaggccccuc

SEQ ID NO: 17980 - RNA, 22 nt, Artificial Sequence
  Guide Sequence
ugcuuucauuagccugcucguu

SEQ ID NO: 17981 - RNA, 22 nt, Artificial Sequence
  Guide Sequence
uggagauggugggagugcccac

SEQ ID NO: 17982 - RNA, 22 nt, Artificial Sequence
  Guide Sequence
uggaguagccuugaggcccggu

SEQ ID NO: 17983 - RNA, 22 nt, Artificial Sequence
  Guide Sequence
uggcccuggagauggugggagu

SEQ ID NO: 17984 - RNA, 22 nt, Artificial Sequence
  Guide Sequence
uggcugacuagcccaggcucca

SEQ ID NO: 17985 - RNA, 22 nt, Artificial Sequence
  Guide Sequence
ugggagugcccacccagggugc

SEQ ID NO: 17986 - RNA, 22 nt, Artificial Sequence
  Guide Sequence
ugggugaggagagggggcuguc

SEQ ID NO: 17987 - RNA, 22 nt, Artificial Sequence
  Guide Sequence
uggguguuaguguguguuuuca

SEQ ID NO: 17988 - RNA, 22 nt, Artificial Sequence
  Guide Sequence
ugguccugcauagucugcccag

SEQ ID NO: 17989 - RNA, 22 nt, Artificial Sequence
  Guide Sequence
uggugggagugcccacccaggg

SEQ ID NO: 17990 - RNA, 22 nt, Artificial Sequence
  Guide Sequence
ugucaaggaagagcuagccggg

SEQ ID NO: 17991 - RNA, 22 nt, Artificial Sequence
  Guide Sequence
ugucaguuucuggguguuagug

SEQ ID NO: 17992 - RNA, 22 nt, Artificial Sequence
  Guide Sequence
uguguguuuucaguuucccuuc

SEQ ID NO: 17993 - RNA, 22 nt, Artificial Sequence
  Guide Sequence
uguguuuucaguuucccuucuu

SEQ ID NO: 17994 - RNA, 22 nt, Artificial Sequence
  Guide Sequence
uguuaguguguguuuucaguuu

SEQ ID NO: 17995 - RNA, 22 nt, Artificial Sequence
  Guide Sequence
uguuuacacacaaggaauuguu

SEQ ID NO: 17996 - RNA, 22 nt, Artificial Sequence
  Guide Sequence
uguuuaccugagaccuugauca

SEQ ID NO: 17997 - RNA, 22 nt, Artificial Sequence
  Guide Sequence
uguuugucaaggaagagcuagc

SEQ ID NO: 17998 - RNA, 22 nt, Artificial Sequence
  Guide Sequence
uguuuucaguuucccuucuuau

SEQ ID NO: 17999 - RNA, 22 nt, Artificial Sequence
  Guide Sequence
uuaaaucucccucucacacuac

SEQ ID NO: 18000 - RNA, 22 nt, Artificial Sequence
  Guide Sequence
uuacacacaaggaauuguuuac

SEQ ID NO: 18001 - RNA, 22 nt, Artificial Sequence
  Guide Sequence
uuaccugagaccuugaucaaga

SEQ ID NO: 18002 - RNA, 22 nt, Artificial Sequence
  Guide Sequence
uuagcgacuaucugcuuucauu

SEQ ID NO: 18003 - RNA, 22 nt, Artificial Sequence
  Guide Sequence
uuagcuguuuacacacaaggaa

SEQ ID NO: 18004 - RNA, 22 nt, Artificial Sequence
  Guide Sequence
uuaguguguguuuucaguuucc

SEQ ID NO: 18005 - RNA, 22 nt, Artificial Sequence
  Guide Sequence
uucauuagccugcucguuaacu

SEQ ID NO: 18006 - RNA, 22 nt, Artificial Sequence
  Guide Sequence
uuccccaacgaaugguccugca

SEQ ID NO: 18007 - RNA, 22 nt, Artificial Sequence
  Guide Sequence
uucccuucuuauaaaacaguga

SEQ ID NO: 18008 - RNA, 22 nt, Artificial Sequence
  Guide Sequence
uucugcagaaaagcaaacagca

SEQ ID NO: 18009 - RNA, 22 nt, Artificial Sequence
  Guide Sequence
uucuggguguuaguguguguuu

SEQ ID NO: 18010 - RNA, 22 nt, Artificial Sequence
  Guide Sequence
uugaggcccggucaucaauucc

SEQ ID NO: 18011 - RNA, 22 nt, Artificial Sequence
  Guide Sequence
uugaucaagacccuuaaaucuc

SEQ ID NO: 18012 - RNA, 22 nt, Artificial Sequence
  Guide Sequence
uugauggaguagccuugaggcc

SEQ ID NO: 18013 - RNA, 22 nt, Artificial Sequence
  Guide Sequence
uuggcccuggagauggugggag

SEQ ID NO: 18014 - RNA, 22 nt, Artificial Sequence
  Guide Sequence
uugucaaggaagagcuagccgg

SEQ ID NO: 18015 - RNA, 22 nt, Artificial Sequence
  Guide Sequence
uuguuuaccugagaccuugauc

SEQ ID NO: 18016 - RNA, 22 nt, Artificial Sequence
  Guide Sequence
uuuaccugagaccuugaucaag

SEQ ID NO: 18017 - RNA, 22 nt, Artificial Sequence
  Guide Sequence
uuuagcgacuaucugcuuucau

SEQ ID NO: 18018 - RNA, 22 nt, Artificial Sequence
  Guide Sequence
uuucauuagccugcucguuaac

SEQ ID NO: 18019 - RNA, 22 nt, Artificial Sequence
  Guide Sequence
uuucccuucuuauaaaacagug

SEQ ID NO: 18020 - RNA, 22 nt, Artificial Sequence
  Guide Sequence
uuucuggguguuaguguguguu

SEQ ID NO: 18021 - RNA, 22 nt, Artificial Sequence
  Guide Sequence
uuugucaaggaagagcuagccg

SEQ ID NO: 18022 - RNA, 20 nt, Artificial Sequence
  Guide Sequence
aaacaacaccccgucagcuc

SEQ ID NO: 18023 - RNA, 20 nt, Artificial Sequence
  Guide Sequence
aaaggacaguccugucugac

SEQ ID NO: 18024 - RNA, 20 nt, Artificial Sequence
  Guide Sequence
aaaugcuugcacaaacaaca

SEQ ID NO: 18025 - RNA, 20 nt, Artificial Sequence
  Guide Sequence
aaauuuggaggcaggcuggc

SEQ ID NO: 18026 - RNA, 20 nt, Artificial Sequence
  Guide Sequence
aacaacaccccgucagcucc

SEQ ID NO: 18027 - RNA, 20 nt, Artificial Sequence
  Guide Sequence
aacaccccgucagcucccag

SEQ ID NO: 18028 - RNA, 20 nt, Artificial Sequence
  Guide Sequence
aacaggaccugugcucacug

SEQ ID NO: 18029 - RNA, 20 nt, Artificial Sequence
  Guide Sequence
aagccuggcucacagccagg

SEQ ID NO: 18030 - RNA, 20 nt, Artificial Sequence
  Guide Sequence
aaggacaguccugucugacu

SEQ ID NO: 18031 - RNA, 20 nt, Artificial Sequence
  Guide Sequence
aaggccugcguuuggggugg

SEQ ID NO: 18032 - RNA, 20 nt, Artificial Sequence
  Guide Sequence
aaggggcugagaacaggacc

SEQ ID NO: 18033 - RNA, 20 nt, Artificial Sequence
  Guide Sequence
aaugcaccugacuagggccc

SEQ ID NO: 18034 - RNA, 20 nt, Artificial Sequence
  Guide Sequence
aaugcuugcacaaacaacac

SEQ ID NO: 18035 - RNA, 20 nt, Artificial Sequence
  Guide Sequence
aauugauuuuucggggcuuu

SEQ ID NO: 18036 - RNA, 20 nt, Artificial Sequence
  Guide Sequence
aauuuggaggcaggcuggcu

SEQ ID NO: 18037 - RNA, 20 nt, Artificial Sequence
  Guide Sequence
acaaacaacaccccgucagc

SEQ ID NO: 18038 - RNA, 20 nt, Artificial Sequence
  Guide Sequence
acaacaccccgucagcuccc

SEQ ID NO: 18039 - RNA, 20 nt, Artificial Sequence
  Guide Sequence
acaccccgucagcucccagg

SEQ ID NO: 18040 - RNA, 20 nt, Artificial Sequence
  Guide Sequence
acagccaggagggaaggggc

SEQ ID NO: 18041 - RNA, 20 nt, Artificial Sequence
  Guide Sequence
acagcccagggugcuggugg

SEQ ID NO: 18042 - RNA, 20 nt, Artificial Sequence
  Guide Sequence
acaggaccugugcucacugg

SEQ ID NO: 18043 - RNA, 20 nt, Artificial Sequence
  Guide Sequence
acaggagaaaggacaguccu

SEQ ID NO: 18044 - RNA, 20 nt, Artificial Sequence
  Guide Sequence
acaguccugucugacuuuuc

SEQ ID NO: 18045 - RNA, 20 nt, Artificial Sequence
  Guide Sequence
accccgucagcucccagggg

SEQ ID NO: 18046 - RNA, 20 nt, Artificial Sequence
  Guide Sequence
accccuguaaucccagcacu

SEQ ID NO: 18047 - RNA, 20 nt, Artificial Sequence
  Guide Sequence
accugacuagggcccucagu

SEQ ID NO: 18048 - RNA, 20 nt, Artificial Sequence
  Guide Sequence
accugugcucacuggggccu

SEQ ID NO: 18049 - RNA, 20 nt, Artificial Sequence
  Guide Sequence
acuacugcccccagcucguu

SEQ ID NO: 18050 - RNA, 20 nt, Artificial Sequence
  Guide Sequence
acuagggcccucagugggac

SEQ ID NO: 18051 - RNA, 20 nt, Artificial Sequence
  Guide Sequence
acugcccccagcucguuaga

SEQ ID NO: 18052 - RNA, 20 nt, Artificial Sequence
  Guide Sequence
acuggggccugcaugacccu

SEQ ID NO: 18053 - RNA, 20 nt, Artificial Sequence
  Guide Sequence
acuuauuuccuucucuggag

SEQ ID NO: 18054 - RNA, 20 nt, Artificial Sequence
  Guide Sequence
acuuuuccuguuggugcugc

SEQ ID NO: 18055 - RNA, 20 nt, Artificial Sequence
  Guide Sequence
agaaaggacaguccugucug

SEQ ID NO: 18056 - RNA, 20 nt, Artificial Sequence
  Guide Sequence
agaaauuuggaggcaggcug

SEQ ID NO: 18057 - RNA, 20 nt, Artificial Sequence
  Guide Sequence
agaacaggaccugugcucac

SEQ ID NO: 18058 - RNA, 20 nt, Artificial Sequence
  Guide Sequence
agaagccuggcucacagcca

SEQ ID NO: 18059 - RNA, 20 nt, Artificial Sequence
  Guide Sequence
agaaugcaccugacuagggc

SEQ ID NO: 18060 - RNA, 20 nt, Artificial Sequence
  Guide Sequence
agacaggagaaaggacaguc

SEQ ID NO: 18061 - RNA, 20 nt, Artificial Sequence
  Guide Sequence
agacuuauuuccuucucugg

SEQ ID NO: 18062 - RNA, 20 nt, Artificial Sequence
  Guide Sequence
agagacaggagaaaggacag

SEQ ID NO: 18063 - RNA, 20 nt, Artificial Sequence
  Guide Sequence
agaggagggcugcccagaga

SEQ ID NO: 18064 - RNA, 20 nt, Artificial Sequence
  Guide Sequence
agccaggagggaaggggcug

SEQ ID NO: 18065 - RNA, 20 nt, Artificial Sequence
  Guide Sequence
agcccagggugcuggugggg

SEQ ID NO: 18066 - RNA, 20 nt, Artificial Sequence
  Guide Sequence
agccuggcucacagccagga

SEQ ID NO: 18067 - RNA, 20 nt, Artificial Sequence
  Guide Sequence
agcucccaggggggcuccca

SEQ ID NO: 18068 - RNA, 20 nt, Artificial Sequence
  Guide Sequence
agcucguuagaaugcaccug

SEQ ID NO: 18069 - RNA, 20 nt, Artificial Sequence
  Guide Sequence
aggacaguccugucugacuu

SEQ ID NO: 18070 - RNA, 20 nt, Artificial Sequence
  Guide Sequence
aggaccugugcucacugggg

SEQ ID NO: 18071 - RNA, 20 nt, Artificial Sequence
  Guide Sequence
aggagaaaggacaguccugu

SEQ ID NO: 18072 - RNA, 20 nt, Artificial Sequence
  Guide Sequence
aggagggaaggggcugagaa

SEQ ID NO: 18073 - RNA, 20 nt, Artificial Sequence
  Guide Sequence
aggagggcugcccagagaca

SEQ ID NO: 18074 - RNA, 20 nt, Artificial Sequence
  Guide Sequence
aggcaggcuggcuguggugu

SEQ ID NO: 18075 - RNA, 20 nt, Artificial Sequence
  Guide Sequence
aggccugcguuugggguggg

SEQ ID NO: 18076 - RNA, 20 nt, Artificial Sequence
  Guide Sequence
aggcuggcuguggugucuca

SEQ ID NO: 18077 - RNA, 20 nt, Artificial Sequence
  Guide Sequence
agggaaggggcugagaacag

SEQ ID NO: 18078 - RNA, 20 nt, Artificial Sequence
  Guide Sequence
agggcacagcccagggugcu

SEQ ID NO: 18079 - RNA, 20 nt, Artificial Sequence
  Guide Sequence
agggcccucagugggacuug

SEQ ID NO: 18080 - RNA, 20 nt, Artificial Sequence
  Guide Sequence
agggcugcccagagacagga

SEQ ID NO: 18081 - RNA, 20 nt, Artificial Sequence
  Guide Sequence
aggggcugagaacaggaccu

SEQ ID NO: 18082 - RNA, 20 nt, Artificial Sequence
  Guide Sequence
aggggggcucccacuacugc

SEQ ID NO: 18083 - RNA, 20 nt, Artificial Sequence
  Guide Sequence
agggugcugguggggucaga

SEQ ID NO: 18084 - RNA, 20 nt, Artificial Sequence
  Guide Sequence
agguagacuuauuuccuucu

SEQ ID NO: 18085 - RNA, 20 nt, Artificial Sequence
  Guide Sequence
aguccugucugacuuuuccu

SEQ ID NO: 18086 - RNA, 20 nt, Artificial Sequence
  Guide Sequence
agucgcugcccaagcauuuc

SEQ ID NO: 18087 - RNA, 20 nt, Artificial Sequence
  Guide Sequence
agugggacuuggcuggcggc

SEQ ID NO: 18088 - RNA, 20 nt, Artificial Sequence
  Guide Sequence
aucuaaaugcuugcacaaac

SEQ ID NO: 18089 - RNA, 20 nt, Artificial Sequence
  Guide Sequence
augcaccugacuagggcccu

SEQ ID NO: 18090 - RNA, 20 nt, Artificial Sequence
  Guide Sequence
augcuugcacaaacaacacc

SEQ ID NO: 18091 - RNA, 20 nt, Artificial Sequence
  Guide Sequence
auugauuuuucggggcuuuu

SEQ ID NO: 18092 - RNA, 20 nt, Artificial Sequence
  Guide Sequence
auuuccuucucuggagggca

SEQ ID NO: 18093 - RNA, 20 nt, Artificial Sequence
  Guide Sequence
auuuggaggcaggcuggcug

SEQ ID NO: 18094 - RNA, 20 nt, Artificial Sequence
  Guide Sequence
auuuuucggggcuuuugauc

SEQ ID NO: 18095 - RNA, 20 nt, Artificial Sequence
  Guide Sequence
caaacaacaccccgucagcu

SEQ ID NO: 18096 - RNA, 20 nt, Artificial Sequence
  Guide Sequence
caacaccccgucagcuccca

SEQ ID NO: 18097 - RNA, 20 nt, Artificial Sequence
  Guide Sequence
caagcauuuccaaagcccau

SEQ ID NO: 18098 - RNA, 20 nt, Artificial Sequence
  Guide Sequence
caauugauuuuucggggcuu

SEQ ID NO: 18099 - RNA, 20 nt, Artificial Sequence
  Guide Sequence
cacaaacaacaccccgucag

SEQ ID NO: 18100 - RNA, 20 nt, Artificial Sequence
  Guide Sequence
cacagccaggagggaagggg

SEQ ID NO: 18101 - RNA, 20 nt, Artificial Sequence
  Guide Sequence
cacagcccagggugcuggug

SEQ ID NO: 18102 - RNA, 20 nt, Artificial Sequence
  Guide Sequence
caccccgucagcucccaggg

SEQ ID NO: 18103 - RNA, 20 nt, Artificial Sequence
  Guide Sequence
caccccuguaaucccagcac

SEQ ID NO: 18104 - RNA, 20 nt, Artificial Sequence
  Guide Sequence
caccugacuagggcccucag

SEQ ID NO: 18105 - RNA, 20 nt, Artificial Sequence
  Guide Sequence
cacuacugcccccagcucgu

SEQ ID NO: 18106 - RNA, 20 nt, Artificial Sequence
  Guide Sequence
cacuggggccugcaugaccc

SEQ ID NO: 18107 - RNA, 20 nt, Artificial Sequence
  Guide Sequence
cagagacaggagaaaggaca

SEQ ID NO: 18108 - RNA, 20 nt, Artificial Sequence
  Guide Sequence
cagaggagggcugcccagag

SEQ ID NO: 18109 - RNA, 20 nt, Artificial Sequence
  Guide Sequence
cagccaggagggaaggggcu

SEQ ID NO: 18110 - RNA, 20 nt, Artificial Sequence
  Guide Sequence
cagcccagggugcugguggg

SEQ ID NO: 18111 - RNA, 20 nt, Artificial Sequence
  Guide Sequence
cagcucccaggggggcuccc

SEQ ID NO: 18112 - RNA, 20 nt, Artificial Sequence
  Guide Sequence
cagcucguuagaaugcaccu

SEQ ID NO: 18113 - RNA, 20 nt, Artificial Sequence
  Guide Sequence
caggaccugugcucacuggg

SEQ ID NO: 18114 - RNA, 20 nt, Artificial Sequence
  Guide Sequence
caggagaaaggacaguccug

SEQ ID NO: 18115 - RNA, 20 nt, Artificial Sequence
  Guide Sequence
caggagggaaggggcugaga

SEQ ID NO: 18116 - RNA, 20 nt, Artificial Sequence
  Guide Sequence
caggcuggcuguggugucuc

SEQ ID NO: 18117 - RNA, 20 nt, Artificial Sequence
  Guide Sequence
caggggggcucccacuacug

SEQ ID NO: 18118 - RNA, 20 nt, Artificial Sequence
  Guide Sequence
cagggugcugguggggucag

SEQ ID NO: 18119 - RNA, 20 nt, Artificial Sequence
  Guide Sequence
cagguagacuuauuuccuuc

SEQ ID NO: 18120 - RNA, 20 nt, Artificial Sequence
  Guide Sequence
caguccugucugacuuuucc

SEQ ID NO: 18121 - RNA, 20 nt, Artificial Sequence
  Guide Sequence
cagugggacuuggcuggcgg

SEQ ID NO: 18122 - RNA, 20 nt, Artificial Sequence
  Guide Sequence
ccaagcauuuccaaagccca

SEQ ID NO: 18123 - RNA, 20 nt, Artificial Sequence
  Guide Sequence
ccaauugauuuuucggggcu

SEQ ID NO: 18124 - RNA, 20 nt, Artificial Sequence
  Guide Sequence
ccacuacugcccccagcucg

SEQ ID NO: 18125 - RNA, 20 nt, Artificial Sequence
  Guide Sequence
ccagagacaggagaaaggac

SEQ ID NO: 18126 - RNA, 20 nt, Artificial Sequence
  Guide Sequence
ccagcucguuagaaugcacc

SEQ ID NO: 18127 - RNA, 20 nt, Artificial Sequence
  Guide Sequence
ccaggagggaaggggcugag

SEQ ID NO: 18128 - RNA, 20 nt, Artificial Sequence
  Guide Sequence
ccaggggggcucccacuacu

SEQ ID NO: 18129 - RNA, 20 nt, Artificial Sequence
  Guide Sequence
ccagggugcuggugggguca

SEQ ID NO: 18130 - RNA, 20 nt, Artificial Sequence
  Guide Sequence
cccaagcauuuccaaagccc

SEQ ID NO: 18131 - RNA, 20 nt, Artificial Sequence
  Guide Sequence
cccaauugauuuuucggggc

SEQ ID NO: 18132 - RNA, 20 nt, Artificial Sequence
  Guide Sequence
cccacuacugcccccagcuc

SEQ ID NO: 18133 - RNA, 20 nt, Artificial Sequence
  Guide Sequence
cccagagacaggagaaagga

SEQ ID NO: 18134 - RNA, 20 nt, Artificial Sequence
  Guide Sequence
cccagcucguuagaaugcac

SEQ ID NO: 18135 - RNA, 20 nt, Artificial Sequence
  Guide Sequence
cccaggggggcucccacuac

SEQ ID NO: 18136 - RNA, 20 nt, Artificial Sequence
  Guide Sequence
cccagggugcuggugggguc

SEQ ID NO: 18137 - RNA, 20 nt, Artificial Sequence
  Guide Sequence
ccccagcucguuagaaugca

SEQ ID NO: 18138 - RNA, 20 nt, Artificial Sequence
  Guide Sequence
cccccagcucguuagaaugc

SEQ ID NO: 18139 - RNA, 20 nt, Artificial Sequence
  Guide Sequence
ccccgucagcucccaggggg

SEQ ID NO: 18140 - RNA, 20 nt, Artificial Sequence
  Guide Sequence
cccgucagcucccagggggg

SEQ ID NO: 18141 - RNA, 20 nt, Artificial Sequence
  Guide Sequence
cccucagugggacuuggcug

SEQ ID NO: 18142 - RNA, 20 nt, Artificial Sequence
  Guide Sequence
cccuuagucgcugcccaagc

SEQ ID NO: 18143 - RNA, 20 nt, Artificial Sequence
  Guide Sequence
ccgucagcucccaggggggc

SEQ ID NO: 18144 - RNA, 20 nt, Artificial Sequence
  Guide Sequence
ccucagugggacuuggcugg

SEQ ID NO: 18145 - RNA, 20 nt, Artificial Sequence
  Guide Sequence
ccugacuagggcccucagug

SEQ ID NO: 18146 - RNA, 20 nt, Artificial Sequence
  Guide Sequence
ccugcaugacccuucccucc

SEQ ID NO: 18147 - RNA, 20 nt, Artificial Sequence
  Guide Sequence
ccugcguuugggguggggcu

SEQ ID NO: 18148 - RNA, 20 nt, Artificial Sequence
  Guide Sequence
ccuggcucacagccaggagg

SEQ ID NO: 18149 - RNA, 20 nt, Artificial Sequence
  Guide Sequence
ccugucugacuuuuccuguu

SEQ ID NO: 18150 - RNA, 20 nt, Artificial Sequence
  Guide Sequence
ccugugcucacuggggccug

SEQ ID NO: 18151 - RNA, 20 nt, Artificial Sequence
  Guide Sequence
ccuguuggugcugcuuagaa

SEQ ID NO: 18152 - RNA, 20 nt, Artificial Sequence
  Guide Sequence
ccuuagucgcugcccaagca

SEQ ID NO: 18153 - RNA, 20 nt, Artificial Sequence
  Guide Sequence
ccuucucuggagggcacagc

SEQ ID NO: 18154 - RNA, 20 nt, Artificial Sequence
  Guide Sequence
cgcugcccaagcauuuccaa

SEQ ID NO: 18155 - RNA, 20 nt, Artificial Sequence
  Guide Sequence
cggggcuuuugaucuaaaug

SEQ ID NO: 18156 - RNA, 20 nt, Artificial Sequence
  Guide Sequence
cgucagcucccaggggggcu

SEQ ID NO: 18157 - RNA, 20 nt, Artificial Sequence
  Guide Sequence
cguuaacuuuucccaauuga

SEQ ID NO: 18158 - RNA, 20 nt, Artificial Sequence
  Guide Sequence
cguuagaaugcaccugacua

SEQ ID NO: 18159 - RNA, 20 nt, Artificial Sequence
  Guide Sequence
cguuugggguggggcugggu

SEQ ID NO: 18160 - RNA, 20 nt, Artificial Sequence
  Guide Sequence
cuaaaugcuugcacaaacaa

SEQ ID NO: 18161 - RNA, 20 nt, Artificial Sequence
  Guide Sequence
cuacugcccccagcucguua

SEQ ID NO: 18162 - RNA, 20 nt, Artificial Sequence
  Guide Sequence
cuagggcccucagugggacu

SEQ ID NO: 18163 - RNA, 20 nt, Artificial Sequence
  Guide Sequence
cucacagccaggagggaagg

SEQ ID NO: 18164 - RNA, 20 nt, Artificial Sequence
  Guide Sequence
cucaccccuguaaucccagc

SEQ ID NO: 18165 - RNA, 20 nt, Artificial Sequence
  Guide Sequence
cucacuggggccugcaugac

SEQ ID NO: 18166 - RNA, 20 nt, Artificial Sequence
  Guide Sequence
cucagugggacuuggcuggc

SEQ ID NO: 18167 - RNA, 20 nt, Artificial Sequence
  Guide Sequence
cucccacuacugcccccagc

SEQ ID NO: 18168 - RNA, 20 nt, Artificial Sequence
  Guide Sequence
cucccaggggggcucccacu

SEQ ID NO: 18169 - RNA, 20 nt, Artificial Sequence
  Guide Sequence
cucguuaacuuuucccaauu

SEQ ID NO: 18170 - RNA, 20 nt, Artificial Sequence
  Guide Sequence
cucguuagaaugcaccugac

SEQ ID NO: 18171 - RNA, 20 nt, Artificial Sequence
  Guide Sequence
cucuggagggcacagcccag

SEQ ID NO: 18172 - RNA, 20 nt, Artificial Sequence
  Guide Sequence
cugacuagggcccucagugg

SEQ ID NO: 18173 - RNA, 20 nt, Artificial Sequence
  Guide Sequence
cugacuuuuccuguuggugc

SEQ ID NO: 18174 - RNA, 20 nt, Artificial Sequence
  Guide Sequence
cugagaacaggaccugugcu

SEQ ID NO: 18175 - RNA, 20 nt, Artificial Sequence
  Guide Sequence
cugcaugacccuucccuccc

SEQ ID NO: 18176 - RNA, 20 nt, Artificial Sequence
  Guide Sequence
cugcccaagcauuuccaaag

SEQ ID NO: 18177 - RNA, 20 nt, Artificial Sequence
  Guide Sequence
cugcccagagacaggagaaa

SEQ ID NO: 18178 - RNA, 20 nt, Artificial Sequence
  Guide Sequence
cugcccccagcucguuagaa

SEQ ID NO: 18179 - RNA, 20 nt, Artificial Sequence
  Guide Sequence
cugcguuugggguggggcug

SEQ ID NO: 18180 - RNA, 20 nt, Artificial Sequence
  Guide Sequence
cugcuuagaaauuuggaggc

SEQ ID NO: 18181 - RNA, 20 nt, Artificial Sequence
  Guide Sequence
cuggagggcacagcccaggg

SEQ ID NO: 18182 - RNA, 20 nt, Artificial Sequence
  Guide Sequence
cuggcucacagccaggaggg

SEQ ID NO: 18183 - RNA, 20 nt, Artificial Sequence
  Guide Sequence
cuggcuguggugucucaccc

SEQ ID NO: 18184 - RNA, 20 nt, Artificial Sequence
  Guide Sequence
cuggggccugcaugacccuu

SEQ ID NO: 18185 - RNA, 20 nt, Artificial Sequence
  Guide Sequence
cugggucccuuagucgcugc

SEQ ID NO: 18186 - RNA, 20 nt, Artificial Sequence
  Guide Sequence
cugguggggucagaggaggg

SEQ ID NO: 18187 - RNA, 20 nt, Artificial Sequence
  Guide Sequence
cugucugacuuuuccuguug

SEQ ID NO: 18188 - RNA, 20 nt, Artificial Sequence
  Guide Sequence
cugugcucacuggggccugc

SEQ ID NO: 18189 - RNA, 20 nt, Artificial Sequence
  Guide Sequence
cuguggugucucaccccugu

SEQ ID NO: 18190 - RNA, 20 nt, Artificial Sequence
  Guide Sequence
cuguuggugcugcuuagaaa

SEQ ID NO: 18191 - RNA, 20 nt, Artificial Sequence
  Guide Sequence
cuuagaaauuuggaggcagg

SEQ ID NO: 18192 - RNA, 20 nt, Artificial Sequence
  Guide Sequence
cuuagucgcugcccaagcau

SEQ ID NO: 18193 - RNA, 20 nt, Artificial Sequence
  Guide Sequence
cuuauuuccuucucuggagg

SEQ ID NO: 18194 - RNA, 20 nt, Artificial Sequence
  Guide Sequence
cuucucuggagggcacagcc

SEQ ID NO: 18195 - RNA, 20 nt, Artificial Sequence
  Guide Sequence
cuugcacaaacaacaccccg

SEQ ID NO: 18196 - RNA, 20 nt, Artificial Sequence
  Guide Sequence
cuuuucccaauugauuuuuc

SEQ ID NO: 18197 - RNA, 20 nt, Artificial Sequence
  Guide Sequence
cuuuuccuguuggugcugcu

SEQ ID NO: 18198 - RNA, 20 nt, Artificial Sequence
  Guide Sequence
cuuuugaucuaaaugcuugc

SEQ ID NO: 18199 - RNA, 20 nt, Artificial Sequence
  Guide Sequence
gaaaggacaguccugucuga

SEQ ID NO: 18200 - RNA, 20 nt, Artificial Sequence
  Guide Sequence
gaaauuuggaggcaggcugg

SEQ ID NO: 18201 - RNA, 20 nt, Artificial Sequence
  Guide Sequence
gaacaggaccugugcucacu

SEQ ID NO: 18202 - RNA, 20 nt, Artificial Sequence
  Guide Sequence
gaagccuggcucacagccag

SEQ ID NO: 18203 - RNA, 20 nt, Artificial Sequence
  Guide Sequence
gaaggggcugagaacaggac

SEQ ID NO: 18204 - RNA, 20 nt, Artificial Sequence
  Guide Sequence
gaaugcaccugacuagggcc

SEQ ID NO: 18205 - RNA, 20 nt, Artificial Sequence
  Guide Sequence
gacaggagaaaggacagucc

SEQ ID NO: 18206 - RNA, 20 nt, Artificial Sequence
  Guide Sequence
gacaguccugucugacuuuu

SEQ ID NO: 18207 - RNA, 20 nt, Artificial Sequence
  Guide Sequence
gaccugugcucacuggggcc

SEQ ID NO: 18208 - RNA, 20 nt, Artificial Sequence
  Guide Sequence
gacuagggcccucaguggga

SEQ ID NO: 18209 - RNA, 20 nt, Artificial Sequence
  Guide Sequence
gacuuauuuccuucucugga

SEQ ID NO: 18210 - RNA, 20 nt, Artificial Sequence
  Guide Sequence
gacuuggcuggcggcaggug

SEQ ID NO: 18211 - RNA, 20 nt, Artificial Sequence
  Guide Sequence
gacuuuuccuguuggugcug

SEQ ID NO: 18212 - RNA, 20 nt, Artificial Sequence
  Guide Sequence
gagaaaggacaguccugucu

SEQ ID NO: 18213 - RNA, 20 nt, Artificial Sequence
  Guide Sequence
gagaacaggaccugugcuca

SEQ ID NO: 18214 - RNA, 20 nt, Artificial Sequence
  Guide Sequence
gagaagccuggcucacagcc

SEQ ID NO: 18215 - RNA, 20 nt, Artificial Sequence
  Guide Sequence
gagacaggagaaaggacagu

SEQ ID NO: 18216 - RNA, 20 nt, Artificial Sequence
  Guide Sequence
gaggagggcugcccagagac

SEQ ID NO: 18217 - RNA, 20 nt, Artificial Sequence
  Guide Sequence
gaggcaggcuggcuguggug

SEQ ID NO: 18218 - RNA, 20 nt, Artificial Sequence
  Guide Sequence
gagggaaggggcugagaaca

SEQ ID NO: 18219 - RNA, 20 nt, Artificial Sequence
  Guide Sequence
gagggcacagcccagggugc

SEQ ID NO: 18220 - RNA, 20 nt, Artificial Sequence
  Guide Sequence
gagggcugcccagagacagg

SEQ ID NO: 18221 - RNA, 20 nt, Artificial Sequence
  Guide Sequence
gaucuaaaugcuugcacaaa

SEQ ID NO: 18222 - RNA, 20 nt, Artificial Sequence
  Guide Sequence
gauuuuucggggcuuuugau

SEQ ID NO: 18223 - RNA, 20 nt, Artificial Sequence
  Guide Sequence
gcacaaacaacaccccguca

SEQ ID NO: 18224 - RNA, 20 nt, Artificial Sequence
  Guide Sequence
gcacagcccagggugcuggu

SEQ ID NO: 18225 - RNA, 20 nt, Artificial Sequence
  Guide Sequence
gcaccugacuagggcccuca

SEQ ID NO: 18226 - RNA, 20 nt, Artificial Sequence
  Guide Sequence
gcaggcuggcuguggugucu

SEQ ID NO: 18227 - RNA, 20 nt, Artificial Sequence
  Guide Sequence
gccaggagggaaggggcuga

SEQ ID NO: 18228 - RNA, 20 nt, Artificial Sequence
  Guide Sequence
gcccaagcauuuccaaagcc

SEQ ID NO: 18229 - RNA, 20 nt, Artificial Sequence
  Guide Sequence
gcccagagacaggagaaagg

SEQ ID NO: 18230 - RNA, 20 nt, Artificial Sequence
  Guide Sequence
gcccagggugcugguggggu

SEQ ID NO: 18231 - RNA, 20 nt, Artificial Sequence
  Guide Sequence
gcccccagcucguuagaaug

SEQ ID NO: 18232 - RNA, 20 nt, Artificial Sequence
  Guide Sequence
gcccucagugggacuuggcu

SEQ ID NO: 18233 - RNA, 20 nt, Artificial Sequence
  Guide Sequence
gccugcaugacccuucccuc

SEQ ID NO: 18234 - RNA, 20 nt, Artificial Sequence
  Guide Sequence
gccugcguuugggguggggc

SEQ ID NO: 18235 - RNA, 20 nt, Artificial Sequence
  Guide Sequence
gccuggcucacagccaggag

SEQ ID NO: 18236 - RNA, 20 nt, Artificial Sequence
  Guide Sequence
gcguuugggguggggcuggg

SEQ ID NO: 18237 - RNA, 20 nt, Artificial Sequence
  Guide Sequence
gcucacagccaggagggaag

SEQ ID NO: 18238 - RNA, 20 nt, Artificial Sequence
  Guide Sequence
gcucacuggggccugcauga

SEQ ID NO: 18239 - RNA, 20 nt, Artificial Sequence
  Guide Sequence
gcucccacuacugcccccag

SEQ ID NO: 18240 - RNA, 20 nt, Artificial Sequence
  Guide Sequence
gcucccaggggggcucccac

SEQ ID NO: 18241 - RNA, 20 nt, Artificial Sequence
  Guide Sequence
gcucguuagaaugcaccuga

SEQ ID NO: 18242 - RNA, 20 nt, Artificial Sequence
  Guide Sequence
gcugagaacaggaccugugc

SEQ ID NO: 18243 - RNA, 20 nt, Artificial Sequence
  Guide Sequence
gcugcccaagcauuuccaaa

SEQ ID NO: 18244 - RNA, 20 nt, Artificial Sequence
  Guide Sequence
gcugcccagagacaggagaa

SEQ ID NO: 18245 - RNA, 20 nt, Artificial Sequence
  Guide Sequence
gcugcuuagaaauuuggagg

SEQ ID NO: 18246 - RNA, 20 nt, Artificial Sequence
  Guide Sequence
gcuggcuguggugucucacc

SEQ ID NO: 18247 - RNA, 20 nt, Artificial Sequence
  Guide Sequence
gcugggucccuuagucgcug

SEQ ID NO: 18248 - RNA, 20 nt, Artificial Sequence
  Guide Sequence
gcugguggggucagaggagg

SEQ ID NO: 18249 - RNA, 20 nt, Artificial Sequence
  Guide Sequence
gcuguggugucucaccccug

SEQ ID NO: 18250 - RNA, 20 nt, Artificial Sequence
  Guide Sequence
gcuuagaaauuuggaggcag

SEQ ID NO: 18251 - RNA, 20 nt, Artificial Sequence
  Guide Sequence
gcuugcacaaacaacacccc

SEQ ID NO: 18252 - RNA, 20 nt, Artificial Sequence
  Guide Sequence
gcuuuugaucuaaaugcuug

SEQ ID NO: 18253 - RNA, 20 nt, Artificial Sequence
  Guide Sequence
ggaaggggcugagaacagga

SEQ ID NO: 18254 - RNA, 20 nt, Artificial Sequence
  Guide Sequence
ggacaguccugucugacuuu

SEQ ID NO: 18255 - RNA, 20 nt, Artificial Sequence
  Guide Sequence
ggaccugugcucacuggggc

SEQ ID NO: 18256 - RNA, 20 nt, Artificial Sequence
  Guide Sequence
ggacuuggcuggcggcaggu

SEQ ID NO: 18257 - RNA, 20 nt, Artificial Sequence
  Guide Sequence
ggagaaaggacaguccuguc

SEQ ID NO: 18258 - RNA, 20 nt, Artificial Sequence
  Guide Sequence
ggaggcaggcuggcuguggu

SEQ ID NO: 18259 - RNA, 20 nt, Artificial Sequence
  Guide Sequence
ggagggaaggggcugagaac

SEQ ID NO: 18260 - RNA, 20 nt, Artificial Sequence
  Guide Sequence
ggagggcacagcccagggug

SEQ ID NO: 18261 - RNA, 20 nt, Artificial Sequence
  Guide Sequence
ggagggcugcccagagacag

SEQ ID NO: 18262 - RNA, 20 nt, Artificial Sequence
  Guide Sequence
ggcacagcccagggugcugg

SEQ ID NO: 18263 - RNA, 20 nt, Artificial Sequence
  Guide Sequence
ggcaggcuggcugugguguc

SEQ ID NO: 18264 - RNA, 20 nt, Artificial Sequence
  Guide Sequence
ggcccucagugggacuuggc

SEQ ID NO: 18265 - RNA, 20 nt, Artificial Sequence
  Guide Sequence
ggccugcaugacccuucccu

SEQ ID NO: 18266 - RNA, 20 nt, Artificial Sequence
  Guide Sequence
ggccugcguuuggggugggg

SEQ ID NO: 18267 - RNA, 20 nt, Artificial Sequence
  Guide Sequence
ggcucacagccaggagggaa

SEQ ID NO: 18268 - RNA, 20 nt, Artificial Sequence
  Guide Sequence
ggcucccacuacugccccca

SEQ ID NO: 18269 - RNA, 20 nt, Artificial Sequence
  Guide Sequence
ggcugagaacaggaccugug

SEQ ID NO: 18270 - RNA, 20 nt, Artificial Sequence
  Guide Sequence
ggcugcccagagacaggaga

SEQ ID NO: 18271 - RNA, 20 nt, Artificial Sequence
  Guide Sequence
ggcuggcuguggugucucac

SEQ ID NO: 18272 - RNA, 20 nt, Artificial Sequence
  Guide Sequence
ggcugggucccuuagucgcu

SEQ ID NO: 18273 - RNA, 20 nt, Artificial Sequence
  Guide Sequence
ggcuguggugucucaccccu

SEQ ID NO: 18274 - RNA, 20 nt, Artificial Sequence
  Guide Sequence
ggcuuuugaucuaaaugcuu

SEQ ID NO: 18275 - RNA, 20 nt, Artificial Sequence
  Guide Sequence
gggaaggggcugagaacagg

SEQ ID NO: 18276 - RNA, 20 nt, Artificial Sequence
  Guide Sequence
gggacuuggcuggcggcagg

SEQ ID NO: 18277 - RNA, 20 nt, Artificial Sequence
  Guide Sequence
gggcacagcccagggugcug

SEQ ID NO: 18278 - RNA, 20 nt, Artificial Sequence
  Guide Sequence
gggcccucagugggacuugg

SEQ ID NO: 18279 - RNA, 20 nt, Artificial Sequence
  Guide Sequence
gggccugcaugacccuuccc

SEQ ID NO: 18280 - RNA, 20 nt, Artificial Sequence
  Guide Sequence
gggcucccacuacugccccc

SEQ ID NO: 18281 - RNA, 20 nt, Artificial Sequence
  Guide Sequence
gggcugagaacaggaccugu

SEQ ID NO: 18282 - RNA, 20 nt, Artificial Sequence
  Guide Sequence
gggcugcccagagacaggag

SEQ ID NO: 18283 - RNA, 20 nt, Artificial Sequence
  Guide Sequence
gggcugggucccuuagucgc

SEQ ID NO: 18284 - RNA, 20 nt, Artificial Sequence
  Guide Sequence
gggcuuuugaucuaaaugcu

SEQ ID NO: 18285 - RNA, 20 nt, Artificial Sequence
  Guide Sequence
ggggccugcaugacccuucc

SEQ ID NO: 18286 - RNA, 20 nt, Artificial Sequence
  Guide Sequence
ggggcucccacuacugcccc

SEQ ID NO: 18287 - RNA, 20 nt, Artificial Sequence
  Guide Sequence
ggggcugagaacaggaccug

SEQ ID NO: 18288 - RNA, 20 nt, Artificial Sequence
  Guide Sequence
ggggcugggucccuuagucg

SEQ ID NO: 18289 - RNA, 20 nt, Artificial Sequence
  Guide Sequence
ggggcuuuugaucuaaaugc

SEQ ID NO: 18290 - RNA, 20 nt, Artificial Sequence
  Guide Sequence
gggggcucccacuacugccc

SEQ ID NO: 18291 - RNA, 20 nt, Artificial Sequence
  Guide Sequence
ggggggcucccacuacugcc

SEQ ID NO: 18292 - RNA, 20 nt, Artificial Sequence
  Guide Sequence
ggggucagaggagggcugcc

SEQ ID NO: 18293 - RNA, 20 nt, Artificial Sequence
  Guide Sequence
gggguggggcugggucccuu

SEQ ID NO: 18294 - RNA, 20 nt, Artificial Sequence
  Guide Sequence
gggucagaggagggcugccc

SEQ ID NO: 18295 - RNA, 20 nt, Artificial Sequence
  Guide Sequence
gggucccuuagucgcugccc

SEQ ID NO: 18296 - RNA, 20 nt, Artificial Sequence
  Guide Sequence
gggugcugguggggucagag

SEQ ID NO: 18297 - RNA, 20 nt, Artificial Sequence
  Guide Sequence
ggguggggcugggucccuua

SEQ ID NO: 18298 - RNA, 20 nt, Artificial Sequence
  Guide Sequence
gguaaggccugcguuugggg

SEQ ID NO: 18299 - RNA, 20 nt, Artificial Sequence
  Guide Sequence
gguagacuuauuuccuucuc

SEQ ID NO: 18300 - RNA, 20 nt, Artificial Sequence
  Guide Sequence
ggucagaggagggcugccca

SEQ ID NO: 18301 - RNA, 20 nt, Artificial Sequence
  Guide Sequence
ggucccuuagucgcugccca

SEQ ID NO: 18302 - RNA, 20 nt, Artificial Sequence
  Guide Sequence
ggugcugcuuagaaauuugg

SEQ ID NO: 18303 - RNA, 20 nt, Artificial Sequence
  Guide Sequence
ggugcugguggggucagagg

SEQ ID NO: 18304 - RNA, 20 nt, Artificial Sequence
  Guide Sequence
gguggggcugggucccuuag

SEQ ID NO: 18305 - RNA, 20 nt, Artificial Sequence
  Guide Sequence
gguggggucagaggagggcu

SEQ ID NO: 18306 - RNA, 20 nt, Artificial Sequence
  Guide Sequence
ggugucucaccccuguaauc

SEQ ID NO: 18307 - RNA, 20 nt, Artificial Sequence
  Guide Sequence
guaaggccugcguuuggggu

SEQ ID NO: 18308 - RNA, 20 nt, Artificial Sequence
  Guide Sequence
guagacuuauuuccuucucu

SEQ ID NO: 18309 - RNA, 20 nt, Artificial Sequence
  Guide Sequence
gucagaggagggcugcccag

SEQ ID NO: 18310 - RNA, 20 nt, Artificial Sequence
  Guide Sequence
gucagcucccaggggggcuc

SEQ ID NO: 18311 - RNA, 20 nt, Artificial Sequence
  Guide Sequence
gucagguagacuuauuuccu

SEQ ID NO: 18312 - RNA, 20 nt, Artificial Sequence
  Guide Sequence
gucccuuagucgcugcccaa

SEQ ID NO: 18313 - RNA, 20 nt, Artificial Sequence
  Guide Sequence
guccugucugacuuuuccug

SEQ ID NO: 18314 - RNA, 20 nt, Artificial Sequence
  Guide Sequence
gucgcugcccaagcauuucc

SEQ ID NO: 18315 - RNA, 20 nt, Artificial Sequence
  Guide Sequence
gucucaccccuguaauccca

SEQ ID NO: 18316 - RNA, 20 nt, Artificial Sequence
  Guide Sequence
gucugacuuuuccuguuggu

SEQ ID NO: 18317 - RNA, 20 nt, Artificial Sequence
  Guide Sequence
gugcucacuggggccugcau

SEQ ID NO: 18318 - RNA, 20 nt, Artificial Sequence
  Guide Sequence
gugcugcuuagaaauuugga

SEQ ID NO: 18319 - RNA, 20 nt, Artificial Sequence
  Guide Sequence
gugcugguggggucagagga

SEQ ID NO: 18320 - RNA, 20 nt, Artificial Sequence
  Guide Sequence
gugggacuuggcuggcggca

SEQ ID NO: 18321 - RNA, 20 nt, Artificial Sequence
  Guide Sequence
guggggcugggucccuuagu

SEQ ID NO: 18322 - RNA, 20 nt, Artificial Sequence
  Guide Sequence
guggggucagaggagggcug

SEQ ID NO: 18323 - RNA, 20 nt, Artificial Sequence
  Guide Sequence
guggugucucaccccuguaa

SEQ ID NO: 18324 - RNA, 20 nt, Artificial Sequence
  Guide Sequence
gugucucaccccuguaaucc

SEQ ID NO: 18325 - RNA, 20 nt, Artificial Sequence
  Guide Sequence
guuaacuuuucccaauugau

SEQ ID NO: 18326 - RNA, 20 nt, Artificial Sequence
  Guide Sequence
guuagaaugcaccugacuag

SEQ ID NO: 18327 - RNA, 20 nt, Artificial Sequence
  Guide Sequence
guuggugcugcuuagaaauu

SEQ ID NO: 18328 - RNA, 20 nt, Artificial Sequence
  Guide Sequence
guuugggguggggcuggguc

SEQ ID NO: 18329 - RNA, 20 nt, Artificial Sequence
  Guide Sequence
uaaaugcuugcacaaacaac

SEQ ID NO: 18330 - RNA, 20 nt, Artificial Sequence
  Guide Sequence
uaaggccugcguuuggggug

SEQ ID NO: 18331 - RNA, 20 nt, Artificial Sequence
  Guide Sequence
uacugcccccagcucguuag

SEQ ID NO: 18332 - RNA, 20 nt, Artificial Sequence
  Guide Sequence
uagaaauuuggaggcaggcu

SEQ ID NO: 18333 - RNA, 20 nt, Artificial Sequence
  Guide Sequence
uagaaugcaccugacuaggg

SEQ ID NO: 18334 - RNA, 20 nt, Artificial Sequence
  Guide Sequence
uagacuuauuuccuucucug

SEQ ID NO: 18335 - RNA, 20 nt, Artificial Sequence
  Guide Sequence
uagggcccucagugggacuu

SEQ ID NO: 18336 - RNA, 20 nt, Artificial Sequence
  Guide Sequence
uagucgcugcccaagcauuu

SEQ ID NO: 18337 - RNA, 20 nt, Artificial Sequence
  Guide Sequence
uauuuccuucucuggagggc

SEQ ID NO: 18338 - RNA, 20 nt, Artificial Sequence
  Guide Sequence
ucacagccaggagggaaggg

SEQ ID NO: 18339 - RNA, 20 nt, Artificial Sequence
  Guide Sequence
ucaccccuguaaucccagca

SEQ ID NO: 18340 - RNA, 20 nt, Artificial Sequence
  Guide Sequence
ucacuggggccugcaugacc

SEQ ID NO: 18341 - RNA, 20 nt, Artificial Sequence
  Guide Sequence
ucagaggagggcugcccaga

SEQ ID NO: 18342 - RNA, 20 nt, Artificial Sequence
  Guide Sequence
ucagcucccaggggggcucc

SEQ ID NO: 18343 - RNA, 20 nt, Artificial Sequence
  Guide Sequence
ucagguagacuuauuuccuu

SEQ ID NO: 18344 - RNA, 20 nt, Artificial Sequence
  Guide Sequence
ucagugggacuuggcuggcg

SEQ ID NO: 18345 - RNA, 20 nt, Artificial Sequence
  Guide Sequence
ucccaauugauuuuucgggg

SEQ ID NO: 18346 - RNA, 20 nt, Artificial Sequence
  Guide Sequence
ucccacuacugcccccagcu

SEQ ID NO: 18347 - RNA, 20 nt, Artificial Sequence
  Guide Sequence
ucccaggggggcucccacua

SEQ ID NO: 18348 - RNA, 20 nt, Artificial Sequence
  Guide Sequence
ucccuuagucgcugcccaag

SEQ ID NO: 18349 - RNA, 20 nt, Artificial Sequence
  Guide Sequence
uccugucugacuuuuccugu

SEQ ID NO: 18350 - RNA, 20 nt, Artificial Sequence
  Guide Sequence
uccuguuggugcugcuuaga

SEQ ID NO: 18351 - RNA, 20 nt, Artificial Sequence
  Guide Sequence
uccuucucuggagggcacag

SEQ ID NO: 18352 - RNA, 20 nt, Artificial Sequence
  Guide Sequence
ucgcugcccaagcauuucca

SEQ ID NO: 18353 - RNA, 20 nt, Artificial Sequence
  Guide Sequence
ucggggcuuuugaucuaaau

SEQ ID NO: 18354 - RNA, 20 nt, Artificial Sequence
  Guide Sequence
ucguuaacuuuucccaauug

SEQ ID NO: 18355 - RNA, 20 nt, Artificial Sequence
  Guide Sequence
ucguuagaaugcaccugacu

SEQ ID NO: 18356 - RNA, 20 nt, Artificial Sequence
  Guide Sequence
ucuaaaugcuugcacaaaca

SEQ ID NO: 18357 - RNA, 20 nt, Artificial Sequence
  Guide Sequence
ucucaccccuguaaucccag

SEQ ID NO: 18358 - RNA, 20 nt, Artificial Sequence
  Guide Sequence
ucucuggagggcacagccca

SEQ ID NO: 18359 - RNA, 20 nt, Artificial Sequence
  Guide Sequence
ucugacuuuuccuguuggug

SEQ ID NO: 18360 - RNA, 20 nt, Artificial Sequence
  Guide Sequence
ucuggagggcacagcccagg

SEQ ID NO: 18361 - RNA, 20 nt, Artificial Sequence
  Guide Sequence
ugacuagggcccucaguggg

SEQ ID NO: 18362 - RNA, 20 nt, Artificial Sequence
  Guide Sequence
ugacuuuuccuguuggugcu

SEQ ID NO: 18363 - RNA, 20 nt, Artificial Sequence
  Guide Sequence
ugagaacaggaccugugcuc

SEQ ID NO: 18364 - RNA, 20 nt, Artificial Sequence
  Guide Sequence
ugagaagccuggcucacagc

SEQ ID NO: 18365 - RNA, 20 nt, Artificial Sequence
  Guide Sequence
ugaucuaaaugcuugcacaa

SEQ ID NO: 18366 - RNA, 20 nt, Artificial Sequence
  Guide Sequence
ugauuuuucggggcuuuuga

SEQ ID NO: 18367 - RNA, 20 nt, Artificial Sequence
  Guide Sequence
ugcacaaacaacaccccguc

SEQ ID NO: 18368 - RNA, 20 nt, Artificial Sequence
  Guide Sequence
ugcaccugacuagggcccuc

SEQ ID NO: 18369 - RNA, 20 nt, Artificial Sequence
  Guide Sequence
ugcccaagcauuuccaaagc

SEQ ID NO: 18370 - RNA, 20 nt, Artificial Sequence
  Guide Sequence
ugcccagagacaggagaaag

SEQ ID NO: 18371 - RNA, 20 nt, Artificial Sequence
  Guide Sequence
ugcccccagcucguuagaau

SEQ ID NO: 18372 - RNA, 20 nt, Artificial Sequence
  Guide Sequence
ugcguuugggguggggcugg

SEQ ID NO: 18373 - RNA, 20 nt, Artificial Sequence
  Guide Sequence
ugcucacuggggccugcaug

SEQ ID NO: 18374 - RNA, 20 nt, Artificial Sequence
  Guide Sequence
ugcugcuuagaaauuuggag

SEQ ID NO: 18375 - RNA, 20 nt, Artificial Sequence
  Guide Sequence
ugcugguggggucagaggag

SEQ ID NO: 18376 - RNA, 20 nt, Artificial Sequence
  Guide Sequence
ugcuuagaaauuuggaggca

SEQ ID NO: 18377 - RNA, 20 nt, Artificial Sequence
  Guide Sequence
ugcuugcacaaacaacaccc

SEQ ID NO: 18378 - RNA, 20 nt, Artificial Sequence
  Guide Sequence
uggaggcaggcuggcugugg

SEQ ID NO: 18379 - RNA, 20 nt, Artificial Sequence
  Guide Sequence
uggagggcacagcccagggu

SEQ ID NO: 18380 - RNA, 20 nt, Artificial Sequence
  Guide Sequence
uggcucacagccaggaggga

SEQ ID NO: 18381 - RNA, 20 nt, Artificial Sequence
  Guide Sequence
uggcuguggugucucacccc

SEQ ID NO: 18382 - RNA, 20 nt, Artificial Sequence
  Guide Sequence
ugggacuuggcuggcggcag

SEQ ID NO: 18383 - RNA, 20 nt, Artificial Sequence
  Guide Sequence
uggggccugcaugacccuuc

SEQ ID NO: 18384 - RNA, 20 nt, Artificial Sequence
  Guide Sequence
uggggcugggucccuuaguc

SEQ ID NO: 18385 - RNA, 20 nt, Artificial Sequence
  Guide Sequence
uggggucagaggagggcugc

SEQ ID NO: 18386 - RNA, 20 nt, Artificial Sequence
  Guide Sequence
ugggguggggcugggucccu

SEQ ID NO: 18387 - RNA, 20 nt, Artificial Sequence
  Guide Sequence
ugggucccuuagucgcugcc

SEQ ID NO: 18388 - RNA, 20 nt, Artificial Sequence
  Guide Sequence
uggugcugcuuagaaauuug

SEQ ID NO: 18389 - RNA, 20 nt, Artificial Sequence
  Guide Sequence
ugguggggucagaggagggc

SEQ ID NO: 18390 - RNA, 20 nt, Artificial Sequence
  Guide Sequence
uggugucucaccccuguaau

SEQ ID NO: 18391 - RNA, 20 nt, Artificial Sequence
  Guide Sequence
ugucagguagacuuauuucc

SEQ ID NO: 18392 - RNA, 20 nt, Artificial Sequence
  Guide Sequence
ugucucaccccuguaauccc

SEQ ID NO: 18393 - RNA, 20 nt, Artificial Sequence
  Guide Sequence
ugucugacuuuuccuguugg

SEQ ID NO: 18394 - RNA, 20 nt, Artificial Sequence
  Guide Sequence
ugugcucacuggggccugca

SEQ ID NO: 18395 - RNA, 20 nt, Artificial Sequence
  Guide Sequence
uguggugucucaccccugua

SEQ ID NO: 18396 - RNA, 20 nt, Artificial Sequence
  Guide Sequence
uguuggugcugcuuagaaau

SEQ ID NO: 18397 - RNA, 20 nt, Artificial Sequence
  Guide Sequence
uuagaaauuuggaggcaggc

SEQ ID NO: 18398 - RNA, 20 nt, Artificial Sequence
  Guide Sequence
uuagaaugcaccugacuagg

SEQ ID NO: 18399 - RNA, 20 nt, Artificial Sequence
  Guide Sequence
uuagucgcugcccaagcauu

SEQ ID NO: 18400 - RNA, 20 nt, Artificial Sequence
  Guide Sequence
uuauuuccuucucuggaggg

SEQ ID NO: 18401 - RNA, 20 nt, Artificial Sequence
  Guide Sequence
uucccaauugauuuuucggg

SEQ ID NO: 18402 - RNA, 20 nt, Artificial Sequence
  Guide Sequence
uuccuguuggugcugcuuag

SEQ ID NO: 18403 - RNA, 20 nt, Artificial Sequence
  Guide Sequence
uuccuucucuggagggcaca

SEQ ID NO: 18404 - RNA, 20 nt, Artificial Sequence
  Guide Sequence
uucggggcuuuugaucuaaa

SEQ ID NO: 18405 - RNA, 20 nt, Artificial Sequence
  Guide Sequence
uucucuggagggcacagccc

SEQ ID NO: 18406 - RNA, 20 nt, Artificial Sequence
  Guide Sequence
uugagaagccuggcucacag

SEQ ID NO: 18407 - RNA, 20 nt, Artificial Sequence
  Guide Sequence
uugaucuaaaugcuugcaca

SEQ ID NO: 18408 - RNA, 20 nt, Artificial Sequence
  Guide Sequence
uugauuuuucggggcuuuug

SEQ ID NO: 18409 - RNA, 20 nt, Artificial Sequence
  Guide Sequence
uugcacaaacaacaccccgu

SEQ ID NO: 18410 - RNA, 20 nt, Artificial Sequence
  Guide Sequence
uuggaggcaggcuggcugug

SEQ ID NO: 18411 - RNA, 20 nt, Artificial Sequence
  Guide Sequence
uugggguggggcuggguccc

SEQ ID NO: 18412 - RNA, 20 nt, Artificial Sequence
  Guide Sequence
uuggugcugcuuagaaauuu

SEQ ID NO: 18413 - RNA, 20 nt, Artificial Sequence
  Guide Sequence
uuucccaauugauuuuucgg

SEQ ID NO: 18414 - RNA, 20 nt, Artificial Sequence
  Guide Sequence
uuuccuguuggugcugcuua

SEQ ID NO: 18415 - RNA, 20 nt, Artificial Sequence
  Guide Sequence
uuuccuucucuggagggcac

SEQ ID NO: 18416 - RNA, 20 nt, Artificial Sequence
  Guide Sequence
uuucggggcuuuugaucuaa

SEQ ID NO: 18417 - RNA, 20 nt, Artificial Sequence
  Guide Sequence
uuugagaagccuggcucaca

SEQ ID NO: 18418 - RNA, 20 nt, Artificial Sequence
  Guide Sequence
uuugaucuaaaugcuugcac

SEQ ID NO: 18419 - RNA, 20 nt, Artificial Sequence
  Guide Sequence
uuuggaggcaggcuggcugu

SEQ ID NO: 18420 - RNA, 20 nt, Artificial Sequence
  Guide Sequence
uuugggguggggcugggucc

SEQ ID NO: 18421 - RNA, 20 nt, Artificial Sequence
  Guide Sequence
uuuucccaauugauuuuucg

SEQ ID NO: 18422 - RNA, 20 nt, Artificial Sequence
  Guide Sequence
uuuuccuguuggugcugcuu

SEQ ID NO: 18423 - RNA, 20 nt, Artificial Sequence
  Guide Sequence
uuuucggggcuuuugaucua

SEQ ID NO: 18424 - RNA, 20 nt, Artificial Sequence
  Guide Sequence
uuuugaucuaaaugcuugca

SEQ ID NO: 18425 - RNA, 20 nt, Artificial Sequence
  Guide Sequence
uuuuucggggcuuuugaucu

SEQ ID NO: 18426 - RNA, 21 nt, Artificial Sequence
  Guide Sequence
aaacaacaccccgucagcucc

SEQ ID NO: 18427 - RNA, 21 nt, Artificial Sequence
  Guide Sequence
aaaggacaguccugucugacu

SEQ ID NO: 18428 - RNA, 21 nt, Artificial Sequence
  Guide Sequence
aaaugcuugcacaaacaacac

SEQ ID NO: 18429 - RNA, 21 nt, Artificial Sequence
  Guide Sequence
aaauuuggaggcaggcuggcu

SEQ ID NO: 18430 - RNA, 21 nt, Artificial Sequence
  Guide Sequence
aacaacaccccgucagcuccc

SEQ ID NO: 18431 - RNA, 21 nt, Artificial Sequence
  Guide Sequence
aacaccccgucagcucccagg

SEQ ID NO: 18432 - RNA, 21 nt, Artificial Sequence
  Guide Sequence
aacaggaccugugcucacugg

SEQ ID NO: 18433 - RNA, 21 nt, Artificial Sequence
  Guide Sequence
aagccuggcucacagccagga

SEQ ID NO: 18434 - RNA, 21 nt, Artificial Sequence
  Guide Sequence
aaggacaguccugucugacuu

SEQ ID NO: 18435 - RNA, 21 nt, Artificial Sequence
  Guide Sequence
aaggccugcguuugggguggg

SEQ ID NO: 18436 - RNA, 21 nt, Artificial Sequence
  Guide Sequence
aaggggcugagaacaggaccu

SEQ ID NO: 18437 - RNA, 21 nt, Artificial Sequence
  Guide Sequence
aaugcaccugacuagggcccu

SEQ ID NO: 18438 - RNA, 21 nt, Artificial Sequence
  Guide Sequence
aaugcuugcacaaacaacacc

SEQ ID NO: 18439 - RNA, 21 nt, Artificial Sequence
  Guide Sequence
aauugauuuuucggggcuuuu

SEQ ID NO: 18440 - RNA, 21 nt, Artificial Sequence
  Guide Sequence
aauuuggaggcaggcuggcug

SEQ ID NO: 18441 - RNA, 21 nt, Artificial Sequence
  Guide Sequence
acaaacaacaccccgucagcu

SEQ ID NO: 18442 - RNA, 21 nt, Artificial Sequence
  Guide Sequence
acaacaccccgucagcuccca

SEQ ID NO: 18443 - RNA, 21 nt, Artificial Sequence
  Guide Sequence
acaccccgucagcucccaggg

SEQ ID NO: 18444 - RNA, 21 nt, Artificial Sequence
  Guide Sequence
acagccaggagggaaggggcu

SEQ ID NO: 18445 - RNA, 21 nt, Artificial Sequence
  Guide Sequence
acagcccagggugcugguggg

SEQ ID NO: 18446 - RNA, 21 nt, Artificial Sequence
  Guide Sequence
acaggaccugugcucacuggg

SEQ ID NO: 18447 - RNA, 21 nt, Artificial Sequence
  Guide Sequence
acaggagaaaggacaguccug

SEQ ID NO: 18448 - RNA, 21 nt, Artificial Sequence
  Guide Sequence
acaguccugucugacuuuucc

SEQ ID NO: 18449 - RNA, 21 nt, Artificial Sequence
  Guide Sequence
accccgucagcucccaggggg

SEQ ID NO: 18450 - RNA, 21 nt, Artificial Sequence
  Guide Sequence
accugacuagggcccucagug

SEQ ID NO: 18451 - RNA, 21 nt, Artificial Sequence
  Guide Sequence
accugugcucacuggggccug

SEQ ID NO: 18452 - RNA, 21 nt, Artificial Sequence
  Guide Sequence
acuacugcccccagcucguua

SEQ ID NO: 18453 - RNA, 21 nt, Artificial Sequence
  Guide Sequence
acuagggcccucagugggacu

SEQ ID NO: 18454 - RNA, 21 nt, Artificial Sequence
  Guide Sequence
acugcccccagcucguuagaa

SEQ ID NO: 18455 - RNA, 21 nt, Artificial Sequence
  Guide Sequence
acuggggccugcaugacccuu

SEQ ID NO: 18456 - RNA, 21 nt, Artificial Sequence
  Guide Sequence
acuuauuuccuucucuggagg

SEQ ID NO: 18457 - RNA, 21 nt, Artificial Sequence
  Guide Sequence
acuuuuccuguuggugcugcu

SEQ ID NO: 18458 - RNA, 21 nt, Artificial Sequence
  Guide Sequence
agaaaggacaguccugucuga

SEQ ID NO: 18459 - RNA, 21 nt, Artificial Sequence
  Guide Sequence
agaaauuuggaggcaggcugg

SEQ ID NO: 18460 - RNA, 21 nt, Artificial Sequence
  Guide Sequence
agaacaggaccugugcucacu

SEQ ID NO: 18461 - RNA, 21 nt, Artificial Sequence
  Guide Sequence
agaagccuggcucacagccag

SEQ ID NO: 18462 - RNA, 21 nt, Artificial Sequence
  Guide Sequence
agaaugcaccugacuagggcc

SEQ ID NO: 18463 - RNA, 21 nt, Artificial Sequence
  Guide Sequence
agacaggagaaaggacagucc

SEQ ID NO: 18464 - RNA, 21 nt, Artificial Sequence
  Guide Sequence
agacuuauuuccuucucugga

SEQ ID NO: 18465 - RNA, 21 nt, Artificial Sequence
  Guide Sequence
agagacaggagaaaggacagu

SEQ ID NO: 18466 - RNA, 21 nt, Artificial Sequence
  Guide Sequence
agaggagggcugcccagagac

SEQ ID NO: 18467 - RNA, 21 nt, Artificial Sequence
  Guide Sequence
agccaggagggaaggggcuga

SEQ ID NO: 18468 - RNA, 21 nt, Artificial Sequence
  Guide Sequence
agcccagggugcugguggggu

SEQ ID NO: 18469 - RNA, 21 nt, Artificial Sequence
  Guide Sequence
agccuggcucacagccaggag

SEQ ID NO: 18470 - RNA, 21 nt, Artificial Sequence
  Guide Sequence
agcucccaggggggcucccac

SEQ ID NO: 18471 - RNA, 21 nt, Artificial Sequence
  Guide Sequence
agcucguuagaaugcaccuga

SEQ ID NO: 18472 - RNA, 21 nt, Artificial Sequence
  Guide Sequence
aggacaguccugucugacuuu

SEQ ID NO: 18473 - RNA, 21 nt, Artificial Sequence
  Guide Sequence
aggaccugugcucacuggggc

SEQ ID NO: 18474 - RNA, 21 nt, Artificial Sequence
  Guide Sequence
aggagaaaggacaguccuguc

SEQ ID NO: 18475 - RNA, 21 nt, Artificial Sequence
  Guide Sequence
aggagggaaggggcugagaac

SEQ ID NO: 18476 - RNA, 21 nt, Artificial Sequence
  Guide Sequence
aggagggcugcccagagacag

SEQ ID NO: 18477 - RNA, 21 nt, Artificial Sequence
  Guide Sequence
aggcaggcuggcugugguguc

SEQ ID NO: 18478 - RNA, 21 nt, Artificial Sequence
  Guide Sequence
aggccugcguuuggggugggg

SEQ ID NO: 18479 - RNA, 21 nt, Artificial Sequence
  Guide Sequence
aggcuggcuguggugucucac

SEQ ID NO: 18480 - RNA, 21 nt, Artificial Sequence
  Guide Sequence
agggaaggggcugagaacagg

SEQ ID NO: 18481 - RNA, 21 nt, Artificial Sequence
  Guide Sequence
agggcacagcccagggugcug

SEQ ID NO: 18482 - RNA, 21 nt, Artificial Sequence
  Guide Sequence
agggcccucagugggacuugg

SEQ ID NO: 18483 - RNA, 21 nt, Artificial Sequence
  Guide Sequence
agggcugcccagagacaggag

SEQ ID NO: 18484 - RNA, 21 nt, Artificial Sequence
  Guide Sequence
aggggcugagaacaggaccug

SEQ ID NO: 18485 - RNA, 21 nt, Artificial Sequence
  Guide Sequence
aggggggcucccacuacugcc

SEQ ID NO: 18486 - RNA, 21 nt, Artificial Sequence
  Guide Sequence
agggugcugguggggucagag

SEQ ID NO: 18487 - RNA, 21 nt, Artificial Sequence
  Guide Sequence
agguagacuuauuuccuucuc

SEQ ID NO: 18488 - RNA, 21 nt, Artificial Sequence
  Guide Sequence
aguccugucugacuuuuccug

SEQ ID NO: 18489 - RNA, 21 nt, Artificial Sequence
  Guide Sequence
agucgcugcccaagcauuucc

SEQ ID NO: 18490 - RNA, 21 nt, Artificial Sequence
  Guide Sequence
agugggacuuggcuggcggca

SEQ ID NO: 18491 - RNA, 21 nt, Artificial Sequence
  Guide Sequence
aucuaaaugcuugcacaaaca

SEQ ID NO: 18492 - RNA, 21 nt, Artificial Sequence
  Guide Sequence
augcaccugacuagggcccuc

SEQ ID NO: 18493 - RNA, 21 nt, Artificial Sequence
  Guide Sequence
augcuugcacaaacaacaccc

SEQ ID NO: 18494 - RNA, 21 nt, Artificial Sequence
  Guide Sequence
auugauuuuucggggcuuuug

SEQ ID NO: 18495 - RNA, 21 nt, Artificial Sequence
  Guide Sequence
auuuccuucucuggagggcac

SEQ ID NO: 18496 - RNA, 21 nt, Artificial Sequence
  Guide Sequence
auuuggaggcaggcuggcugu

SEQ ID NO: 18497 - RNA, 21 nt, Artificial Sequence
  Guide Sequence
auuuuucggggcuuuugaucu

SEQ ID NO: 18498 - RNA, 21 nt, Artificial Sequence
  Guide Sequence
caaacaacaccccgucagcuc

SEQ ID NO: 18499 - RNA, 21 nt, Artificial Sequence
  Guide Sequence
caacaccccgucagcucccag

SEQ ID NO: 18500 - RNA, 21 nt, Artificial Sequence
  Guide Sequence
caauugauuuuucggggcuuu

SEQ ID NO: 18501 - RNA, 21 nt, Artificial Sequence
  Guide Sequence
cacaaacaacaccccgucagc

SEQ ID NO: 18502 - RNA, 21 nt, Artificial Sequence
  Guide Sequence
cacagccaggagggaaggggc

SEQ ID NO: 18503 - RNA, 21 nt, Artificial Sequence
  Guide Sequence
cacagcccagggugcuggugg

SEQ ID NO: 18504 - RNA, 21 nt, Artificial Sequence
  Guide Sequence
caccccgucagcucccagggg

SEQ ID NO: 18505 - RNA, 21 nt, Artificial Sequence
  Guide Sequence
caccccuguaaucccagcacu

SEQ ID NO: 18506 - RNA, 21 nt, Artificial Sequence
  Guide Sequence
caccugacuagggcccucagu

SEQ ID NO: 18507 - RNA, 21 nt, Artificial Sequence
  Guide Sequence
cacuacugcccccagcucguu

SEQ ID NO: 18508 - RNA, 21 nt, Artificial Sequence
  Guide Sequence
cacuggggccugcaugacccu

SEQ ID NO: 18509 - RNA, 21 nt, Artificial Sequence
  Guide Sequence
cagagacaggagaaaggacag

SEQ ID NO: 18510 - RNA, 21 nt, Artificial Sequence
  Guide Sequence
cagaggagggcugcccagaga

SEQ ID NO: 18511 - RNA, 21 nt, Artificial Sequence
  Guide Sequence
cagccaggagggaaggggcug

SEQ ID NO: 18512 - RNA, 21 nt, Artificial Sequence
  Guide Sequence
cagcccagggugcuggugggg

SEQ ID NO: 18513 - RNA, 21 nt, Artificial Sequence
  Guide Sequence
cagcucccaggggggcuccca

SEQ ID NO: 18514 - RNA, 21 nt, Artificial Sequence
  Guide Sequence
cagcucguuagaaugcaccug

SEQ ID NO: 18515 - RNA, 21 nt, Artificial Sequence
  Guide Sequence
caggaccugugcucacugggg

SEQ ID NO: 18516 - RNA, 21 nt, Artificial Sequence
  Guide Sequence
caggagaaaggacaguccugu

SEQ ID NO: 18517 - RNA, 21 nt, Artificial Sequence
  Guide Sequence
caggagggaaggggcugagaa

SEQ ID NO: 18518 - RNA, 21 nt, Artificial Sequence
  Guide Sequence
caggcuggcuguggugucuca

SEQ ID NO: 18519 - RNA, 21 nt, Artificial Sequence
  Guide Sequence
caggggggcucccacuacugc

SEQ ID NO: 18520 - RNA, 21 nt, Artificial Sequence
  Guide Sequence
cagggugcugguggggucaga

SEQ ID NO: 18521 - RNA, 21 nt, Artificial Sequence
  Guide Sequence
cagguagacuuauuuccuucu

SEQ ID NO: 18522 - RNA, 21 nt, Artificial Sequence
  Guide Sequence
caguccugucugacuuuuccu

SEQ ID NO: 18523 - RNA, 21 nt, Artificial Sequence
  Guide Sequence
cagugggacuuggcuggcggc

SEQ ID NO: 18524 - RNA, 21 nt, Artificial Sequence
  Guide Sequence
ccaagcauuuccaaagcccau

SEQ ID NO: 18525 - RNA, 21 nt, Artificial Sequence
  Guide Sequence
ccaauugauuuuucggggcuu

SEQ ID NO: 18526 - RNA, 21 nt, Artificial Sequence
  Guide Sequence
ccacuacugcccccagcucgu

SEQ ID NO: 18527 - RNA, 21 nt, Artificial Sequence
  Guide Sequence
ccagagacaggagaaaggaca

SEQ ID NO: 18528 - RNA, 21 nt, Artificial Sequence
  Guide Sequence
ccagcucguuagaaugcaccu

SEQ ID NO: 18529 - RNA, 21 nt, Artificial Sequence
  Guide Sequence
ccaggagggaaggggcugaga

SEQ ID NO: 18530 - RNA, 21 nt, Artificial Sequence
  Guide Sequence
ccaggggggcucccacuacug

SEQ ID NO: 18531 - RNA, 21 nt, Artificial Sequence
  Guide Sequence
ccagggugcugguggggucag

SEQ ID NO: 18532 - RNA, 21 nt, Artificial Sequence
  Guide Sequence
cccaagcauuuccaaagccca

SEQ ID NO: 18533 - RNA, 21 nt, Artificial Sequence
  Guide Sequence
cccaauugauuuuucggggcu

SEQ ID NO: 18534 - RNA, 21 nt, Artificial Sequence
  Guide Sequence
cccacuacugcccccagcucg

SEQ ID NO: 18535 - RNA, 21 nt, Artificial Sequence
  Guide Sequence
cccagagacaggagaaaggac

SEQ ID NO: 18536 - RNA, 21 nt, Artificial Sequence
  Guide Sequence
cccagcucguuagaaugcacc

SEQ ID NO: 18537 - RNA, 21 nt, Artificial Sequence
  Guide Sequence
cccaggggggcucccacuacu

SEQ ID NO: 18538 - RNA, 21 nt, Artificial Sequence
  Guide Sequence
cccagggugcuggugggguca

SEQ ID NO: 18539 - RNA, 21 nt, Artificial Sequence
  Guide Sequence
ccccagcucguuagaaugcac

SEQ ID NO: 18540 - RNA, 21 nt, Artificial Sequence
  Guide Sequence
cccccagcucguuagaaugca

SEQ ID NO: 18541 - RNA, 21 nt, Artificial Sequence
  Guide Sequence
cccucagugggacuuggcugg

SEQ ID NO: 18542 - RNA, 21 nt, Artificial Sequence
  Guide Sequence
cccuuagucgcugcccaagca

SEQ ID NO: 18543 - RNA, 21 nt, Artificial Sequence
  Guide Sequence
ccgucagcucccaggggggcu

SEQ ID NO: 18544 - RNA, 21 nt, Artificial Sequence
  Guide Sequence
ccucagugggacuuggcuggc

SEQ ID NO: 18545 - RNA, 21 nt, Artificial Sequence
  Guide Sequence
ccugacuagggcccucagugg

SEQ ID NO: 18546 - RNA, 21 nt, Artificial Sequence
  Guide Sequence
ccugcaugacccuucccuccc

SEQ ID NO: 18547 - RNA, 21 nt, Artificial Sequence
  Guide Sequence
ccugcguuugggguggggcug

SEQ ID NO: 18548 - RNA, 21 nt, Artificial Sequence
  Guide Sequence
ccuggcucacagccaggaggg

SEQ ID NO: 18549 - RNA, 21 nt, Artificial Sequence
  Guide Sequence
ccugucugacuuuuccuguug

SEQ ID NO: 18550 - RNA, 21 nt, Artificial Sequence
  Guide Sequence
ccugugcucacuggggccugc

SEQ ID NO: 18551 - RNA, 21 nt, Artificial Sequence
  Guide Sequence
ccuguuggugcugcuuagaaa

SEQ ID NO: 18552 - RNA, 21 nt, Artificial Sequence
  Guide Sequence
ccuuagucgcugcccaagcau

SEQ ID NO: 18553 - RNA, 21 nt, Artificial Sequence
  Guide Sequence
ccuucucuggagggcacagcc

SEQ ID NO: 18554 - RNA, 21 nt, Artificial Sequence
  Guide Sequence
cgcugcccaagcauuuccaaa

SEQ ID NO: 18555 - RNA, 21 nt, Artificial Sequence
  Guide Sequence
cggggcuuuugaucuaaaugc

SEQ ID NO: 18556 - RNA, 21 nt, Artificial Sequence
  Guide Sequence
cgucagcucccaggggggcuc

SEQ ID NO: 18557 - RNA, 21 nt, Artificial Sequence
  Guide Sequence
cguuaacuuuucccaauugau

SEQ ID NO: 18558 - RNA, 21 nt, Artificial Sequence
  Guide Sequence
cguuagaaugcaccugacuag

SEQ ID NO: 18559 - RNA, 21 nt, Artificial Sequence
  Guide Sequence
cguuugggguggggcuggguc

SEQ ID NO: 18560 - RNA, 21 nt, Artificial Sequence
  Guide Sequence
cuaaaugcuugcacaaacaac

SEQ ID NO: 18561 - RNA, 21 nt, Artificial Sequence
  Guide Sequence
cuacugcccccagcucguuag

SEQ ID NO: 18562 - RNA, 21 nt, Artificial Sequence
  Guide Sequence
cuagggcccucagugggacuu

SEQ ID NO: 18563 - RNA, 21 nt, Artificial Sequence
  Guide Sequence
cucacagccaggagggaaggg

SEQ ID NO: 18564 - RNA, 21 nt, Artificial Sequence
  Guide Sequence
cucaccccuguaaucccagca

SEQ ID NO: 18565 - RNA, 21 nt, Artificial Sequence
  Guide Sequence
cucacuggggccugcaugacc

SEQ ID NO: 18566 - RNA, 21 nt, Artificial Sequence
  Guide Sequence
cucagugggacuuggcuggcg

SEQ ID NO: 18567 - RNA, 21 nt, Artificial Sequence
  Guide Sequence
cucccacuacugcccccagcu

SEQ ID NO: 18568 - RNA, 21 nt, Artificial Sequence
  Guide Sequence
cucccaggggggcucccacua

SEQ ID NO: 18569 - RNA, 21 nt, Artificial Sequence
  Guide Sequence
cucguuaacuuuucccaauug

SEQ ID NO: 18570 - RNA, 21 nt, Artificial Sequence
  Guide Sequence
cucguuagaaugcaccugacu

SEQ ID NO: 18571 - RNA, 21 nt, Artificial Sequence
  Guide Sequence
cucuggagggcacagcccagg

SEQ ID NO: 18572 - RNA, 21 nt, Artificial Sequence
  Guide Sequence
cugacuagggcccucaguggg

SEQ ID NO: 18573 - RNA, 21 nt, Artificial Sequence
  Guide Sequence
cugacuuuuccuguuggugcu

SEQ ID NO: 18574 - RNA, 21 nt, Artificial Sequence
  Guide Sequence
cugagaacaggaccugugcuc

SEQ ID NO: 18575 - RNA, 21 nt, Artificial Sequence
  Guide Sequence
cugcccaagcauuuccaaagc

SEQ ID NO: 18576 - RNA, 21 nt, Artificial Sequence
  Guide Sequence
cugcccagagacaggagaaag

SEQ ID NO: 18577 - RNA, 21 nt, Artificial Sequence
  Guide Sequence
cugcccccagcucguuagaau

SEQ ID NO: 18578 - RNA, 21 nt, Artificial Sequence
  Guide Sequence
cugcguuugggguggggcugg

SEQ ID NO: 18579 - RNA, 21 nt, Artificial Sequence
  Guide Sequence
cugcuuagaaauuuggaggca

SEQ ID NO: 18580 - RNA, 21 nt, Artificial Sequence
  Guide Sequence
cuggagggcacagcccagggu

SEQ ID NO: 18581 - RNA, 21 nt, Artificial Sequence
  Guide Sequence
cuggcucacagccaggaggga

SEQ ID NO: 18582 - RNA, 21 nt, Artificial Sequence
  Guide Sequence
cuggcuguggugucucacccc

SEQ ID NO: 18583 - RNA, 21 nt, Artificial Sequence
  Guide Sequence
cuggggccugcaugacccuuc

SEQ ID NO: 18584 - RNA, 21 nt, Artificial Sequence
  Guide Sequence
cugggucccuuagucgcugcc

SEQ ID NO: 18585 - RNA, 21 nt, Artificial Sequence
  Guide Sequence
cugguggggucagaggagggc

SEQ ID NO: 18586 - RNA, 21 nt, Artificial Sequence
  Guide Sequence
cugucugacuuuuccuguugg

SEQ ID NO: 18587 - RNA, 21 nt, Artificial Sequence
  Guide Sequence
cugugcucacuggggccugca

SEQ ID NO: 18588 - RNA, 21 nt, Artificial Sequence
  Guide Sequence
cuguggugucucaccccugua

SEQ ID NO: 18589 - RNA, 21 nt, Artificial Sequence
  Guide Sequence
cuguuggugcugcuuagaaau

SEQ ID NO: 18590 - RNA, 21 nt, Artificial Sequence
  Guide Sequence
cuuagaaauuuggaggcaggc

SEQ ID NO: 18591 - RNA, 21 nt, Artificial Sequence
  Guide Sequence
cuuagucgcugcccaagcauu

SEQ ID NO: 18592 - RNA, 21 nt, Artificial Sequence
  Guide Sequence
cuuauuuccuucucuggaggg

SEQ ID NO: 18593 - RNA, 21 nt, Artificial Sequence
  Guide Sequence
cuucucuggagggcacagccc

SEQ ID NO: 18594 - RNA, 21 nt, Artificial Sequence
  Guide Sequence
cuugcacaaacaacaccccgu

SEQ ID NO: 18595 - RNA, 21 nt, Artificial Sequence
  Guide Sequence
cuuuucccaauugauuuuucg

SEQ ID NO: 18596 - RNA, 21 nt, Artificial Sequence
  Guide Sequence
cuuuuccuguuggugcugcuu

SEQ ID NO: 18597 - RNA, 21 nt, Artificial Sequence
  Guide Sequence
cuuuugaucuaaaugcuugca

SEQ ID NO: 18598 - RNA, 21 nt, Artificial Sequence
  Guide Sequence
gaaaggacaguccugucugac

SEQ ID NO: 18599 - RNA, 21 nt, Artificial Sequence
  Guide Sequence
gaaauuuggaggcaggcuggc

SEQ ID NO: 18600 - RNA, 21 nt, Artificial Sequence
  Guide Sequence
gaacaggaccugugcucacug

SEQ ID NO: 18601 - RNA, 21 nt, Artificial Sequence
  Guide Sequence
gaagccuggcucacagccagg

SEQ ID NO: 18602 - RNA, 21 nt, Artificial Sequence
  Guide Sequence
gaaggggcugagaacaggacc

SEQ ID NO: 18603 - RNA, 21 nt, Artificial Sequence
  Guide Sequence
gaaugcaccugacuagggccc

SEQ ID NO: 18604 - RNA, 21 nt, Artificial Sequence
  Guide Sequence
gacaggagaaaggacaguccu

SEQ ID NO: 18605 - RNA, 21 nt, Artificial Sequence
  Guide Sequence
gacaguccugucugacuuuuc

SEQ ID NO: 18606 - RNA, 21 nt, Artificial Sequence
  Guide Sequence
gaccugugcucacuggggccu

SEQ ID NO: 18607 - RNA, 21 nt, Artificial Sequence
  Guide Sequence
gacuagggcccucagugggac

SEQ ID NO: 18608 - RNA, 21 nt, Artificial Sequence
  Guide Sequence
gacuuauuuccuucucuggag

SEQ ID NO: 18609 - RNA, 21 nt, Artificial Sequence
  Guide Sequence
gacuuuuccuguuggugcugc

SEQ ID NO: 18610 - RNA, 21 nt, Artificial Sequence
  Guide Sequence
gagaaaggacaguccugucug

SEQ ID NO: 18611 - RNA, 21 nt, Artificial Sequence
  Guide Sequence
gagaacaggaccugugcucac

SEQ ID NO: 18612 - RNA, 21 nt, Artificial Sequence
  Guide Sequence
gagaagccuggcucacagcca

SEQ ID NO: 18613 - RNA, 21 nt, Artificial Sequence
  Guide Sequence
gagacaggagaaaggacaguc

SEQ ID NO: 18614 - RNA, 21 nt, Artificial Sequence
  Guide Sequence
gaggagggcugcccagagaca

SEQ ID NO: 18615 - RNA, 21 nt, Artificial Sequence
  Guide Sequence
gaggcaggcuggcuguggugu

SEQ ID NO: 18616 - RNA, 21 nt, Artificial Sequence
  Guide Sequence
gagggaaggggcugagaacag

SEQ ID NO: 18617 - RNA, 21 nt, Artificial Sequence
  Guide Sequence
gagggcacagcccagggugcu

SEQ ID NO: 18618 - RNA, 21 nt, Artificial Sequence
  Guide Sequence
gagggcugcccagagacagga

SEQ ID NO: 18619 - RNA, 21 nt, Artificial Sequence
  Guide Sequence
gaucuaaaugcuugcacaaac

SEQ ID NO: 18620 - RNA, 21 nt, Artificial Sequence
  Guide Sequence
gauuuuucggggcuuuugauc

SEQ ID NO: 18621 - RNA, 21 nt, Artificial Sequence
  Guide Sequence
gcacaaacaacaccccgucag

SEQ ID NO: 18622 - RNA, 21 nt, Artificial Sequence
  Guide Sequence
gcacagcccagggugcuggug

SEQ ID NO: 18623 - RNA, 21 nt, Artificial Sequence
  Guide Sequence
gcaccugacuagggcccucag

SEQ ID NO: 18624 - RNA, 21 nt, Artificial Sequence
  Guide Sequence
gcaggcuggcuguggugucuc

SEQ ID NO: 18625 - RNA, 21 nt, Artificial Sequence
  Guide Sequence
gccaggagggaaggggcugag

SEQ ID NO: 18626 - RNA, 21 nt, Artificial Sequence
  Guide Sequence
gcccaagcauuuccaaagccc

SEQ ID NO: 18627 - RNA, 21 nt, Artificial Sequence
  Guide Sequence
gcccagagacaggagaaagga

SEQ ID NO: 18628 - RNA, 21 nt, Artificial Sequence
  Guide Sequence
gcccagggugcuggugggguc

SEQ ID NO: 18629 - RNA, 21 nt, Artificial Sequence
  Guide Sequence
gcccccagcucguuagaaugc

SEQ ID NO: 18630 - RNA, 21 nt, Artificial Sequence
  Guide Sequence
gcccucagugggacuuggcug

SEQ ID NO: 18631 - RNA, 21 nt, Artificial Sequence
  Guide Sequence
gccugcaugacccuucccucc

SEQ ID NO: 18632 - RNA, 21 nt, Artificial Sequence
  Guide Sequence
gccugcguuugggguggggcu

SEQ ID NO: 18633 - RNA, 21 nt, Artificial Sequence
  Guide Sequence
gccuggcucacagccaggagg

SEQ ID NO: 18634 - RNA, 21 nt, Artificial Sequence
  Guide Sequence
gcguuugggguggggcugggu

SEQ ID NO: 18635 - RNA, 21 nt, Artificial Sequence
  Guide Sequence
gcucacagccaggagggaagg

SEQ ID NO: 18636 - RNA, 21 nt, Artificial Sequence
  Guide Sequence
gcucacuggggccugcaugac

SEQ ID NO: 18637 - RNA, 21 nt, Artificial Sequence
  Guide Sequence
gcucccacuacugcccccagc

SEQ ID NO: 18638 - RNA, 21 nt, Artificial Sequence
  Guide Sequence
gcucccaggggggcucccacu

SEQ ID NO: 18639 - RNA, 21 nt, Artificial Sequence
  Guide Sequence
gcucguuagaaugcaccugac

SEQ ID NO: 18640 - RNA, 21 nt, Artificial Sequence
  Guide Sequence
gcugagaacaggaccugugcu

SEQ ID NO: 18641 - RNA, 21 nt, Artificial Sequence
  Guide Sequence
gcugcccaagcauuuccaaag

SEQ ID NO: 18642 - RNA, 21 nt, Artificial Sequence
  Guide Sequence
gcugcccagagacaggagaaa

SEQ ID NO: 18643 - RNA, 21 nt, Artificial Sequence
  Guide Sequence
gcugcuuagaaauuuggaggc

SEQ ID NO: 18644 - RNA, 21 nt, Artificial Sequence
  Guide Sequence
gcuggcuguggugucucaccc

SEQ ID NO: 18645 - RNA, 21 nt, Artificial Sequence
  Guide Sequence
gcugggucccuuagucgcugc

SEQ ID NO: 18646 - RNA, 21 nt, Artificial Sequence
  Guide Sequence
gcugguggggucagaggaggg

SEQ ID NO: 18647 - RNA, 21 nt, Artificial Sequence
  Guide Sequence
gcuguggugucucaccccugu

SEQ ID NO: 18648 - RNA, 21 nt, Artificial Sequence
  Guide Sequence
gcuuagaaauuuggaggcagg

SEQ ID NO: 18649 - RNA, 21 nt, Artificial Sequence
  Guide Sequence
gcuugcacaaacaacaccccg

SEQ ID NO: 18650 - RNA, 21 nt, Artificial Sequence
  Guide Sequence
gcuuuugaucuaaaugcuugc

SEQ ID NO: 18651 - RNA, 21 nt, Artificial Sequence
  Guide Sequence
ggaaggggcugagaacaggac

SEQ ID NO: 18652 - RNA, 21 nt, Artificial Sequence
  Guide Sequence
ggacaguccugucugacuuuu

SEQ ID NO: 18653 - RNA, 21 nt, Artificial Sequence
  Guide Sequence
ggaccugugcucacuggggcc

SEQ ID NO: 18654 - RNA, 21 nt, Artificial Sequence
  Guide Sequence
ggacuuggcuggcggcaggug

SEQ ID NO: 18655 - RNA, 21 nt, Artificial Sequence
  Guide Sequence
ggagaaaggacaguccugucu

SEQ ID NO: 18656 - RNA, 21 nt, Artificial Sequence
  Guide Sequence
ggaggcaggcuggcuguggug

SEQ ID NO: 18657 - RNA, 21 nt, Artificial Sequence
  Guide Sequence
ggagggaaggggcugagaaca

SEQ ID NO: 18658 - RNA, 21 nt, Artificial Sequence
  Guide Sequence
ggagggcacagcccagggugc

SEQ ID NO: 18659 - RNA, 21 nt, Artificial Sequence
  Guide Sequence
ggagggcugcccagagacagg

SEQ ID NO: 18660 - RNA, 21 nt, Artificial Sequence
  Guide Sequence
ggcacagcccagggugcuggu

SEQ ID NO: 18661 - RNA, 21 nt, Artificial Sequence
  Guide Sequence
ggcaggcuggcuguggugucu

SEQ ID NO: 18662 - RNA, 21 nt, Artificial Sequence
  Guide Sequence
ggcccucagugggacuuggcu

SEQ ID NO: 18663 - RNA, 21 nt, Artificial Sequence
  Guide Sequence
ggccugcaugacccuucccuc

SEQ ID NO: 18664 - RNA, 21 nt, Artificial Sequence
  Guide Sequence
ggccugcguuugggguggggc

SEQ ID NO: 18665 - RNA, 21 nt, Artificial Sequence
  Guide Sequence
ggcucacagccaggagggaag

SEQ ID NO: 18666 - RNA, 21 nt, Artificial Sequence
  Guide Sequence
ggcucccacuacugcccccag

SEQ ID NO: 18667 - RNA, 21 nt, Artificial Sequence
  Guide Sequence
ggcugagaacaggaccugugc

SEQ ID NO: 18668 - RNA, 21 nt, Artificial Sequence
  Guide Sequence
ggcugcccagagacaggagaa

SEQ ID NO: 18669 - RNA, 21 nt, Artificial Sequence
  Guide Sequence
ggcuggcuguggugucucacc

SEQ ID NO: 18670 - RNA, 21 nt, Artificial Sequence
  Guide Sequence
ggcugggucccuuagucgcug

SEQ ID NO: 18671 - RNA, 21 nt, Artificial Sequence
  Guide Sequence
ggcuguggugucucaccccug

SEQ ID NO: 18672 - RNA, 21 nt, Artificial Sequence
  Guide Sequence
ggcuuuugaucuaaaugcuug

SEQ ID NO: 18673 - RNA, 21 nt, Artificial Sequence
  Guide Sequence
gggaaggggcugagaacagga

SEQ ID NO: 18674 - RNA, 21 nt, Artificial Sequence
  Guide Sequence
gggacuuggcuggcggcaggu

SEQ ID NO: 18675 - RNA, 21 nt, Artificial Sequence
  Guide Sequence
gggcacagcccagggugcugg

SEQ ID NO: 18676 - RNA, 21 nt, Artificial Sequence
  Guide Sequence
gggcccucagugggacuuggc

SEQ ID NO: 18677 - RNA, 21 nt, Artificial Sequence
  Guide Sequence
gggccugcaugacccuucccu

SEQ ID NO: 18678 - RNA, 21 nt, Artificial Sequence
  Guide Sequence
gggcucccacuacugccccca

SEQ ID NO: 18679 - RNA, 21 nt, Artificial Sequence
  Guide Sequence
gggcugagaacaggaccugug

SEQ ID NO: 18680 - RNA, 21 nt, Artificial Sequence
  Guide Sequence
gggcugcccagagacaggaga

SEQ ID NO: 18681 - RNA, 21 nt, Artificial Sequence
  Guide Sequence
gggcugggucccuuagucgcu

SEQ ID NO: 18682 - RNA, 21 nt, Artificial Sequence
  Guide Sequence
gggcuuuugaucuaaaugcuu

SEQ ID NO: 18683 - RNA, 21 nt, Artificial Sequence
  Guide Sequence
ggggccugcaugacccuuccc

SEQ ID NO: 18684 - RNA, 21 nt, Artificial Sequence
  Guide Sequence
ggggcucccacuacugccccc

SEQ ID NO: 18685 - RNA, 21 nt, Artificial Sequence
  Guide Sequence
ggggcugagaacaggaccugu

SEQ ID NO: 18686 - RNA, 21 nt, Artificial Sequence
  Guide Sequence
ggggcugggucccuuagucgc

SEQ ID NO: 18687 - RNA, 21 nt, Artificial Sequence
  Guide Sequence
ggggcuuuugaucuaaaugcu

SEQ ID NO: 18688 - RNA, 21 nt, Artificial Sequence
  Guide Sequence
gggggcucccacuacugcccc

SEQ ID NO: 18689 - RNA, 21 nt, Artificial Sequence
  Guide Sequence
ggggggcucccacuacugccc

SEQ ID NO: 18690 - RNA, 21 nt, Artificial Sequence
  Guide Sequence
ggggucagaggagggcugccc

SEQ ID NO: 18691 - RNA, 21 nt, Artificial Sequence
  Guide Sequence
gggguggggcugggucccuua

SEQ ID NO: 18692 - RNA, 21 nt, Artificial Sequence
  Guide Sequence
gggucagaggagggcugccca

SEQ ID NO: 18693 - RNA, 21 nt, Artificial Sequence
  Guide Sequence
gggucccuuagucgcugccca

SEQ ID NO: 18694 - RNA, 21 nt, Artificial Sequence
  Guide Sequence
gggugcugguggggucagagg

SEQ ID NO: 18695 - RNA, 21 nt, Artificial Sequence
  Guide Sequence
ggguggggcugggucccuuag

SEQ ID NO: 18696 - RNA, 21 nt, Artificial Sequence
  Guide Sequence
gguaaggccugcguuuggggu

SEQ ID NO: 18697 - RNA, 21 nt, Artificial Sequence
  Guide Sequence
gguagacuuauuuccuucucu

SEQ ID NO: 18698 - RNA, 21 nt, Artificial Sequence
  Guide Sequence
ggucagaggagggcugcccag

SEQ ID NO: 18699 - RNA, 21 nt, Artificial Sequence
  Guide Sequence
ggucccuuagucgcugcccaa

SEQ ID NO: 18700 - RNA, 21 nt, Artificial Sequence
  Guide Sequence
ggugcugcuuagaaauuugga

SEQ ID NO: 18701 - RNA, 21 nt, Artificial Sequence
  Guide Sequence
ggugcugguggggucagagga

SEQ ID NO: 18702 - RNA, 21 nt, Artificial Sequence
  Guide Sequence
gguggggcugggucccuuagu

SEQ ID NO: 18703 - RNA, 21 nt, Artificial Sequence
  Guide Sequence
gguggggucagaggagggcug

SEQ ID NO: 18704 - RNA, 21 nt, Artificial Sequence
  Guide Sequence
ggugucucaccccuguaaucc

SEQ ID NO: 18705 - RNA, 21 nt, Artificial Sequence
  Guide Sequence
guaaggccugcguuuggggug

SEQ ID NO: 18706 - RNA, 21 nt, Artificial Sequence
  Guide Sequence
guagacuuauuuccuucucug

SEQ ID NO: 18707 - RNA, 21 nt, Artificial Sequence
  Guide Sequence
gucagaggagggcugcccaga

SEQ ID NO: 18708 - RNA, 21 nt, Artificial Sequence
  Guide Sequence
gucagcucccaggggggcucc

SEQ ID NO: 18709 - RNA, 21 nt, Artificial Sequence
  Guide Sequence
gucagguagacuuauuuccuu

SEQ ID NO: 18710 - RNA, 21 nt, Artificial Sequence
  Guide Sequence
gucccuuagucgcugcccaag

SEQ ID NO: 18711 - RNA, 21 nt, Artificial Sequence
  Guide Sequence
guccugucugacuuuuccugu

SEQ ID NO: 18712 - RNA, 21 nt, Artificial Sequence
  Guide Sequence
gucgcugcccaagcauuucca

SEQ ID NO: 18713 - RNA, 21 nt, Artificial Sequence
  Guide Sequence
gucucaccccuguaaucccag

SEQ ID NO: 18714 - RNA, 21 nt, Artificial Sequence
  Guide Sequence
gucugacuuuuccuguuggug

SEQ ID NO: 18715 - RNA, 21 nt, Artificial Sequence
  Guide Sequence
gugcucacuggggccugcaug

SEQ ID NO: 18716 - RNA, 21 nt, Artificial Sequence
  Guide Sequence
gugcugcuuagaaauuuggag

SEQ ID NO: 18717 - RNA, 21 nt, Artificial Sequence
  Guide Sequence
gugcugguggggucagaggag

SEQ ID NO: 18718 - RNA, 21 nt, Artificial Sequence
  Guide Sequence
gugggacuuggcuggcggcag

SEQ ID NO: 18719 - RNA, 21 nt, Artificial Sequence
  Guide Sequence
guggggcugggucccuuaguc

SEQ ID NO: 18720 - RNA, 21 nt, Artificial Sequence
  Guide Sequence
guggggucagaggagggcugc

SEQ ID NO: 18721 - RNA, 21 nt, Artificial Sequence
  Guide Sequence
guggugucucaccccuguaau

SEQ ID NO: 18722 - RNA, 21 nt, Artificial Sequence
  Guide Sequence
gugucucaccccuguaauccc

SEQ ID NO: 18723 - RNA, 21 nt, Artificial Sequence
  Guide Sequence
guuagaaugcaccugacuagg

SEQ ID NO: 18724 - RNA, 21 nt, Artificial Sequence
  Guide Sequence
guuggugcugcuuagaaauuu

SEQ ID NO: 18725 - RNA, 21 nt, Artificial Sequence
  Guide Sequence
guuugggguggggcugggucc

SEQ ID NO: 18726 - RNA, 21 nt, Artificial Sequence
  Guide Sequence
uaaaugcuugcacaaacaaca

SEQ ID NO: 18727 - RNA, 21 nt, Artificial Sequence
  Guide Sequence
uaaggccugcguuuggggugg

SEQ ID NO: 18728 - RNA, 21 nt, Artificial Sequence
  Guide Sequence
uacugcccccagcucguuaga

SEQ ID NO: 18729 - RNA, 21 nt, Artificial Sequence
  Guide Sequence
uagaaauuuggaggcaggcug

SEQ ID NO: 18730 - RNA, 21 nt, Artificial Sequence
  Guide Sequence
uagaaugcaccugacuagggc

SEQ ID NO: 18731 - RNA, 21 nt, Artificial Sequence
  Guide Sequence
uagacuuauuuccuucucugg

SEQ ID NO: 18732 - RNA, 21 nt, Artificial Sequence
  Guide Sequence
uagggcccucagugggacuug

SEQ ID NO: 18733 - RNA, 21 nt, Artificial Sequence
  Guide Sequence
uagucgcugcccaagcauuuc

SEQ ID NO: 18734 - RNA, 21 nt, Artificial Sequence
  Guide Sequence
uauuuccuucucuggagggca

SEQ ID NO: 18735 - RNA, 21 nt, Artificial Sequence
  Guide Sequence
ucacagccaggagggaagggg

SEQ ID NO: 18736 - RNA, 21 nt, Artificial Sequence
  Guide Sequence
ucaccccuguaaucccagcac

SEQ ID NO: 18737 - RNA, 21 nt, Artificial Sequence
  Guide Sequence
ucacuggggccugcaugaccc

SEQ ID NO: 18738 - RNA, 21 nt, Artificial Sequence
  Guide Sequence
ucagaggagggcugcccagag

SEQ ID NO: 18739 - RNA, 21 nt, Artificial Sequence
  Guide Sequence
ucagcucccaggggggcuccc

SEQ ID NO: 18740 - RNA, 21 nt, Artificial Sequence
  Guide Sequence
ucagguagacuuauuuccuuc

SEQ ID NO: 18741 - RNA, 21 nt, Artificial Sequence
  Guide Sequence
ucagugggacuuggcuggcgg

SEQ ID NO: 18742 - RNA, 21 nt, Artificial Sequence
  Guide Sequence
ucccaauugauuuuucggggc

SEQ ID NO: 18743 - RNA, 21 nt, Artificial Sequence
  Guide Sequence
ucccacuacugcccccagcuc

SEQ ID NO: 18744 - RNA, 21 nt, Artificial Sequence
  Guide Sequence
ucccaggggggcucccacuac

SEQ ID NO: 18745 - RNA, 21 nt, Artificial Sequence
  Guide Sequence
ucccuuagucgcugcccaagc

SEQ ID NO: 18746 - RNA, 21 nt, Artificial Sequence
  Guide Sequence
uccugucugacuuuuccuguu

SEQ ID NO: 18747 - RNA, 21 nt, Artificial Sequence
  Guide Sequence
uccuguuggugcugcuuagaa

SEQ ID NO: 18748 - RNA, 21 nt, Artificial Sequence
  Guide Sequence
uccuucucuggagggcacagc

SEQ ID NO: 18749 - RNA, 21 nt, Artificial Sequence
  Guide Sequence
ucgcugcccaagcauuuccaa

SEQ ID NO: 18750 - RNA, 21 nt, Artificial Sequence
  Guide Sequence
ucggggcuuuugaucuaaaug

SEQ ID NO: 18751 - RNA, 21 nt, Artificial Sequence
  Guide Sequence
ucguuaacuuuucccaauuga

SEQ ID NO: 18752 - RNA, 21 nt, Artificial Sequence
  Guide Sequence
ucguuagaaugcaccugacua

SEQ ID NO: 18753 - RNA, 21 nt, Artificial Sequence
  Guide Sequence
ucuaaaugcuugcacaaacaa

SEQ ID NO: 18754 - RNA, 21 nt, Artificial Sequence
  Guide Sequence
ucucaccccuguaaucccagc

SEQ ID NO: 18755 - RNA, 21 nt, Artificial Sequence
  Guide Sequence
ucucuggagggcacagcccag

SEQ ID NO: 18756 - RNA, 21 nt, Artificial Sequence
  Guide Sequence
ucugacuuuuccuguuggugc

SEQ ID NO: 18757 - RNA, 21 nt, Artificial Sequence
  Guide Sequence
ucuggagggcacagcccaggg

SEQ ID NO: 18758 - RNA, 21 nt, Artificial Sequence
  Guide Sequence
ugacuagggcccucaguggga

SEQ ID NO: 18759 - RNA, 21 nt, Artificial Sequence
  Guide Sequence
ugacuuuuccuguuggugcug

SEQ ID NO: 18760 - RNA, 21 nt, Artificial Sequence
  Guide Sequence
ugagaacaggaccugugcuca

SEQ ID NO: 18761 - RNA, 21 nt, Artificial Sequence
  Guide Sequence
ugagaagccuggcucacagcc

SEQ ID NO: 18762 - RNA, 21 nt, Artificial Sequence
  Guide Sequence
ugaucuaaaugcuugcacaaa

SEQ ID NO: 18763 - RNA, 21 nt, Artificial Sequence
  Guide Sequence
ugauuuuucggggcuuuugau

SEQ ID NO: 18764 - RNA, 21 nt, Artificial Sequence
  Guide Sequence
ugcacaaacaacaccccguca

SEQ ID NO: 18765 - RNA, 21 nt, Artificial Sequence
  Guide Sequence
ugcaccugacuagggcccuca

SEQ ID NO: 18766 - RNA, 21 nt, Artificial Sequence
  Guide Sequence
ugcccaagcauuuccaaagcc

SEQ ID NO: 18767 - RNA, 21 nt, Artificial Sequence
  Guide Sequence
ugcccagagacaggagaaagg

SEQ ID NO: 18768 - RNA, 21 nt, Artificial Sequence
  Guide Sequence
ugcccccagcucguuagaaug

SEQ ID NO: 18769 - RNA, 21 nt, Artificial Sequence
  Guide Sequence
ugcguuugggguggggcuggg

SEQ ID NO: 18770 - RNA, 21 nt, Artificial Sequence
  Guide Sequence
ugcucacuggggccugcauga

SEQ ID NO: 18771 - RNA, 21 nt, Artificial Sequence
  Guide Sequence
ugcugcuuagaaauuuggagg

SEQ ID NO: 18772 - RNA, 21 nt, Artificial Sequence
  Guide Sequence
ugcugguggggucagaggagg

SEQ ID NO: 18773 - RNA, 21 nt, Artificial Sequence
  Guide Sequence
ugcuuagaaauuuggaggcag

SEQ ID NO: 18774 - RNA, 21 nt, Artificial Sequence
  Guide Sequence
ugcuugcacaaacaacacccc

SEQ ID NO: 18775 - RNA, 21 nt, Artificial Sequence
  Guide Sequence
uggaggcaggcuggcuguggu

SEQ ID NO: 18776 - RNA, 21 nt, Artificial Sequence
  Guide Sequence
uggagggcacagcccagggug

SEQ ID NO: 18777 - RNA, 21 nt, Artificial Sequence
  Guide Sequence
uggcucacagccaggagggaa

SEQ ID NO: 18778 - RNA, 21 nt, Artificial Sequence
  Guide Sequence
uggcuguggugucucaccccu

SEQ ID NO: 18779 - RNA, 21 nt, Artificial Sequence
  Guide Sequence
ugggacuuggcuggcggcagg

SEQ ID NO: 18780 - RNA, 21 nt, Artificial Sequence
  Guide Sequence
uggggccugcaugacccuucc

SEQ ID NO: 18781 - RNA, 21 nt, Artificial Sequence
  Guide Sequence
uggggcugggucccuuagucg

SEQ ID NO: 18782 - RNA, 21 nt, Artificial Sequence
  Guide Sequence
uggggucagaggagggcugcc

SEQ ID NO: 18783 - RNA, 21 nt, Artificial Sequence
  Guide Sequence
ugggguggggcugggucccuu

SEQ ID NO: 18784 - RNA, 21 nt, Artificial Sequence
  Guide Sequence
ugggucccuuagucgcugccc

SEQ ID NO: 18785 - RNA, 21 nt, Artificial Sequence
  Guide Sequence
uggugcugcuuagaaauuugg

SEQ ID NO: 18786 - RNA, 21 nt, Artificial Sequence
  Guide Sequence
ugguggggucagaggagggcu

SEQ ID NO: 18787 - RNA, 21 nt, Artificial Sequence
  Guide Sequence
uggugucucaccccuguaauc

SEQ ID NO: 18788 - RNA, 21 nt, Artificial Sequence
  Guide Sequence
ugucagguagacuuauuuccu

SEQ ID NO: 18789 - RNA, 21 nt, Artificial Sequence
  Guide Sequence
ugucucaccccuguaauccca

SEQ ID NO: 18790 - RNA, 21 nt, Artificial Sequence
  Guide Sequence
ugucugacuuuuccuguuggu

SEQ ID NO: 18791 - RNA, 21 nt, Artificial Sequence
  Guide Sequence
ugugcucacuggggccugcau

SEQ ID NO: 18792 - RNA, 21 nt, Artificial Sequence
  Guide Sequence
uguggugucucaccccuguaa

SEQ ID NO: 18793 - RNA, 21 nt, Artificial Sequence
  Guide Sequence
uguuggugcugcuuagaaauu

SEQ ID NO: 18794 - RNA, 21 nt, Artificial Sequence
  Guide Sequence
uuagaaauuuggaggcaggcu

SEQ ID NO: 18795 - RNA, 21 nt, Artificial Sequence
  Guide Sequence
uuagaaugcaccugacuaggg

SEQ ID NO: 18796 - RNA, 21 nt, Artificial Sequence
  Guide Sequence
uuagucgcugcccaagcauuu

SEQ ID NO: 18797 - RNA, 21 nt, Artificial Sequence
  Guide Sequence
uuauuuccuucucuggagggc

SEQ ID NO: 18798 - RNA, 21 nt, Artificial Sequence
  Guide Sequence
uucccaauugauuuuucgggg

SEQ ID NO: 18799 - RNA, 21 nt, Artificial Sequence
  Guide Sequence
uuccuguuggugcugcuuaga

SEQ ID NO: 18800 - RNA, 21 nt, Artificial Sequence
  Guide Sequence
uuccuucucuggagggcacag

SEQ ID NO: 18801 - RNA, 21 nt, Artificial Sequence
  Guide Sequence
uucggggcuuuugaucuaaau

SEQ ID NO: 18802 - RNA, 21 nt, Artificial Sequence
  Guide Sequence
uucucuggagggcacagccca

SEQ ID NO: 18803 - RNA, 21 nt, Artificial Sequence
  Guide Sequence
uugagaagccuggcucacagc

SEQ ID NO: 18804 - RNA, 21 nt, Artificial Sequence
  Guide Sequence
uugaucuaaaugcuugcacaa

SEQ ID NO: 18805 - RNA, 21 nt, Artificial Sequence
  Guide Sequence
uugauuuuucggggcuuuuga

SEQ ID NO: 18806 - RNA, 21 nt, Artificial Sequence
  Guide Sequence
uugcacaaacaacaccccguc

SEQ ID NO: 18807 - RNA, 21 nt, Artificial Sequence
  Guide Sequence
uuggaggcaggcuggcugugg

SEQ ID NO: 18808 - RNA, 21 nt, Artificial Sequence
  Guide Sequence
uugggguggggcugggucccu

SEQ ID NO: 18809 - RNA, 21 nt, Artificial Sequence
  Guide Sequence
uuggugcugcuuagaaauuug

SEQ ID NO: 18810 - RNA, 21 nt, Artificial Sequence
  Guide Sequence
uuucccaauugauuuuucggg

SEQ ID NO: 18811 - RNA, 21 nt, Artificial Sequence
  Guide Sequence
uuuccuguuggugcugcuuag

SEQ ID NO: 18812 - RNA, 21 nt, Artificial Sequence
  Guide Sequence
uuuccuucucuggagggcaca

SEQ ID NO: 18813 - RNA, 21 nt, Artificial Sequence
  Guide Sequence
uuucggggcuuuugaucuaaa

SEQ ID NO: 18814 - RNA, 21 nt, Artificial Sequence
  Guide Sequence
uuugagaagccuggcucacag

SEQ ID NO: 18815 - RNA, 21 nt, Artificial Sequence
  Guide Sequence
uuugaucuaaaugcuugcaca

SEQ ID NO: 18816 - RNA, 21 nt, Artificial Sequence
  Guide Sequence
uuuggaggcaggcuggcugug

SEQ ID NO: 18817 - RNA, 21 nt, Artificial Sequence
  Guide Sequence
uuugggguggggcuggguccc

SEQ ID NO: 18818 - RNA, 21 nt, Artificial Sequence
  Guide Sequence
uuuucccaauugauuuuucgg

SEQ ID NO: 18819 - RNA, 21 nt, Artificial Sequence
  Guide Sequence
uuuuccuguuggugcugcuua

SEQ ID NO: 18820 - RNA, 21 nt, Artificial Sequence
  Guide Sequence
uuuucggggcuuuugaucuaa

SEQ ID NO: 18821 - RNA, 21 nt, Artificial Sequence
  Guide Sequence
uuuugaucuaaaugcuugcac

SEQ ID NO: 18822 - RNA, 21 nt, Artificial Sequence
  Guide Sequence
uuuuucggggcuuuugaucua

SEQ ID NO: 18823 - RNA, 22 nt, Artificial Sequence
  Guide Sequence
aaacaacaccccgucagcuccc

SEQ ID NO: 18824 - RNA, 22 nt, Artificial Sequence
  Guide Sequence
aaaggacaguccugucugacuu

SEQ ID NO: 18825 - RNA, 22 nt, Artificial Sequence
  Guide Sequence
aaaugcuugcacaaacaacacc

SEQ ID NO: 18826 - RNA, 22 nt, Artificial Sequence
  Guide Sequence
aaauuuggaggcaggcuggcug

SEQ ID NO: 18827 - RNA, 22 nt, Artificial Sequence
  Guide Sequence
aacaacaccccgucagcuccca

SEQ ID NO: 18828 - RNA, 22 nt, Artificial Sequence
  Guide Sequence
aacaccccgucagcucccaggg

SEQ ID NO: 18829 - RNA, 22 nt, Artificial Sequence
  Guide Sequence
aacaggaccugugcucacuggg

SEQ ID NO: 18830 - RNA, 22 nt, Artificial Sequence
  Guide Sequence
aagccuggcucacagccaggag

SEQ ID NO: 18831 - RNA, 22 nt, Artificial Sequence
  Guide Sequence
aaggacaguccugucugacuuu

SEQ ID NO: 18832 - RNA, 22 nt, Artificial Sequence
  Guide Sequence
aaggccugcguuuggggugggg

SEQ ID NO: 18833 - RNA, 22 nt, Artificial Sequence
  Guide Sequence
aaggggcugagaacaggaccug

SEQ ID NO: 18834 - RNA, 22 nt, Artificial Sequence
  Guide Sequence
aaugcaccugacuagggcccuc

SEQ ID NO: 18835 - RNA, 22 nt, Artificial Sequence
  Guide Sequence
aaugcuugcacaaacaacaccc

SEQ ID NO: 18836 - RNA, 22 nt, Artificial Sequence
  Guide Sequence
aauugauuuuucggggcuuuug

SEQ ID NO: 18837 - RNA, 22 nt, Artificial Sequence
  Guide Sequence
aauuuggaggcaggcuggcugu

SEQ ID NO: 18838 - RNA, 22 nt, Artificial Sequence
  Guide Sequence
acaaacaacaccccgucagcuc

SEQ ID NO: 18839 - RNA, 22 nt, Artificial Sequence
  Guide Sequence
acaacaccccgucagcucccag

SEQ ID NO: 18840 - RNA, 22 nt, Artificial Sequence
  Guide Sequence
acaccccgucagcucccagggg

SEQ ID NO: 18841 - RNA, 22 nt, Artificial Sequence
  Guide Sequence
acagccaggagggaaggggcug

SEQ ID NO: 18842 - RNA, 22 nt, Artificial Sequence
  Guide Sequence
acagcccagggugcuggugggg

SEQ ID NO: 18843 - RNA, 22 nt, Artificial Sequence
  Guide Sequence
acaggaccugugcucacugggg

SEQ ID NO: 18844 - RNA, 22 nt, Artificial Sequence
  Guide Sequence
acaggagaaaggacaguccugu

SEQ ID NO: 18845 - RNA, 22 nt, Artificial Sequence
  Guide Sequence
acaguccugucugacuuuuccu

SEQ ID NO: 18846 - RNA, 22 nt, Artificial Sequence
  Guide Sequence
accccgucagcucccagggggg

SEQ ID NO: 18847 - RNA, 22 nt, Artificial Sequence
  Guide Sequence
accugacuagggcccucagugg

SEQ ID NO: 18848 - RNA, 22 nt, Artificial Sequence
  Guide Sequence
accugugcucacuggggccugc

SEQ ID NO: 18849 - RNA, 22 nt, Artificial Sequence
  Guide Sequence
acuacugcccccagcucguuag

SEQ ID NO: 18850 - RNA, 22 nt, Artificial Sequence
  Guide Sequence
acuagggcccucagugggacuu

SEQ ID NO: 18851 - RNA, 22 nt, Artificial Sequence
  Guide Sequence
acugcccccagcucguuagaau

SEQ ID NO: 18852 - RNA, 22 nt, Artificial Sequence
  Guide Sequence
acuggggccugcaugacccuuc

SEQ ID NO: 18853 - RNA, 22 nt, Artificial Sequence
  Guide Sequence
acuuauuuccuucucuggaggg

SEQ ID NO: 18854 - RNA, 22 nt, Artificial Sequence
  Guide Sequence
acuuuucccaauugauuuuucg

SEQ ID NO: 18855 - RNA, 22 nt, Artificial Sequence
  Guide Sequence
acuuuuccuguuggugcugcuu

SEQ ID NO: 18856 - RNA, 22 nt, Artificial Sequence
  Guide Sequence
agaaaggacaguccugucugac

SEQ ID NO: 18857 - RNA, 22 nt, Artificial Sequence
  Guide Sequence
agaaauuuggaggcaggcuggc

SEQ ID NO: 18858 - RNA, 22 nt, Artificial Sequence
  Guide Sequence
agaacaggaccugugcucacug

SEQ ID NO: 18859 - RNA, 22 nt, Artificial Sequence
  Guide Sequence
agaagccuggcucacagccagg

SEQ ID NO: 18860 - RNA, 22 nt, Artificial Sequence
  Guide Sequence
agaaugcaccugacuagggccc

SEQ ID NO: 18861 - RNA, 22 nt, Artificial Sequence
  Guide Sequence
agacaggagaaaggacaguccu

SEQ ID NO: 18862 - RNA, 22 nt, Artificial Sequence
  Guide Sequence
agacuuauuuccuucucuggag

SEQ ID NO: 18863 - RNA, 22 nt, Artificial Sequence
  Guide Sequence
agagacaggagaaaggacaguc

SEQ ID NO: 18864 - RNA, 22 nt, Artificial Sequence
  Guide Sequence
agaggagggcugcccagagaca

SEQ ID NO: 18865 - RNA, 22 nt, Artificial Sequence
  Guide Sequence
agccaggagggaaggggcugag

SEQ ID NO: 18866 - RNA, 22 nt, Artificial Sequence
  Guide Sequence
agcccagggugcuggugggguc

SEQ ID NO: 18867 - RNA, 22 nt, Artificial Sequence
  Guide Sequence
agccuggcucacagccaggagg

SEQ ID NO: 18868 - RNA, 22 nt, Artificial Sequence
  Guide Sequence
agcucccaggggggcucccacu

SEQ ID NO: 18869 - RNA, 22 nt, Artificial Sequence
  Guide Sequence
agcucguuagaaugcaccugac

SEQ ID NO: 18870 - RNA, 22 nt, Artificial Sequence
  Guide Sequence
aggacaguccugucugacuuuu

SEQ ID NO: 18871 - RNA, 22 nt, Artificial Sequence
  Guide Sequence
aggaccugugcucacuggggcc

SEQ ID NO: 18872 - RNA, 22 nt, Artificial Sequence
  Guide Sequence
aggagaaaggacaguccugucu

SEQ ID NO: 18873 - RNA, 22 nt, Artificial Sequence
  Guide Sequence
aggagggaaggggcugagaaca

SEQ ID NO: 18874 - RNA, 22 nt, Artificial Sequence
  Guide Sequence
aggagggcugcccagagacagg

SEQ ID NO: 18875 - RNA, 22 nt, Artificial Sequence
  Guide Sequence
aggcaggcuggcuguggugucu

SEQ ID NO: 18876 - RNA, 22 nt, Artificial Sequence
  Guide Sequence
aggccugcguuugggguggggc

SEQ ID NO: 18877 - RNA, 22 nt, Artificial Sequence
  Guide Sequence
aggcuggcuguggugucucacc

SEQ ID NO: 18878 - RNA, 22 nt, Artificial Sequence
  Guide Sequence
agggaaggggcugagaacagga

SEQ ID NO: 18879 - RNA, 22 nt, Artificial Sequence
  Guide Sequence
agggcacagcccagggugcugg

SEQ ID NO: 18880 - RNA, 22 nt, Artificial Sequence
  Guide Sequence
agggcccucagugggacuuggc

SEQ ID NO: 18881 - RNA, 22 nt, Artificial Sequence
  Guide Sequence
agggcugcccagagacaggaga

SEQ ID NO: 18882 - RNA, 22 nt, Artificial Sequence
  Guide Sequence
aggggcugagaacaggaccugu

SEQ ID NO: 18883 - RNA, 22 nt, Artificial Sequence
  Guide Sequence
aggggggcucccacuacugccc

SEQ ID NO: 18884 - RNA, 22 nt, Artificial Sequence
  Guide Sequence
agggugcugguggggucagagg

SEQ ID NO: 18885 - RNA, 22 nt, Artificial Sequence
  Guide Sequence
agguagacuuauuuccuucucu

SEQ ID NO: 18886 - RNA, 22 nt, Artificial Sequence
  Guide Sequence
aguccugucugacuuuuccugu

SEQ ID NO: 18887 - RNA, 22 nt, Artificial Sequence
  Guide Sequence
agucgcugcccaagcauuucca

SEQ ID NO: 18888 - RNA, 22 nt, Artificial Sequence
  Guide Sequence
agugggacuuggcuggcggcag

SEQ ID NO: 18889 - RNA, 22 nt, Artificial Sequence
  Guide Sequence
aucuaaaugcuugcacaaacaa

SEQ ID NO: 18890 - RNA, 22 nt, Artificial Sequence
  Guide Sequence
augcaccugacuagggcccuca

SEQ ID NO: 18891 - RNA, 22 nt, Artificial Sequence
  Guide Sequence
augcuugcacaaacaacacccc

SEQ ID NO: 18892 - RNA, 22 nt, Artificial Sequence
  Guide Sequence
auugauuuuucggggcuuuuga

SEQ ID NO: 18893 - RNA, 22 nt, Artificial Sequence
  Guide Sequence
auuuccuucucuggagggcaca

SEQ ID NO: 18894 - RNA, 22 nt, Artificial Sequence
  Guide Sequence
auuuggaggcaggcuggcugug

SEQ ID NO: 18895 - RNA, 22 nt, Artificial Sequence
  Guide Sequence
auuuuucggggcuuuugaucua

SEQ ID NO: 18896 - RNA, 22 nt, Artificial Sequence
  Guide Sequence
caaacaacaccccgucagcucc

SEQ ID NO: 18897 - RNA, 22 nt, Artificial Sequence
  Guide Sequence
caacaccccgucagcucccagg

SEQ ID NO: 18898 - RNA, 22 nt, Artificial Sequence
  Guide Sequence
caauugauuuuucggggcuuuu

SEQ ID NO: 18899 - RNA, 22 nt, Artificial Sequence
  Guide Sequence
cacaaacaacaccccgucagcu

SEQ ID NO: 18900 - RNA, 22 nt, Artificial Sequence
  Guide Sequence
cacagccaggagggaaggggcu

SEQ ID NO: 18901 - RNA, 22 nt, Artificial Sequence
  Guide Sequence
cacagcccagggugcugguggg

SEQ ID NO: 18902 - RNA, 22 nt, Artificial Sequence
  Guide Sequence
caccccgucagcucccaggggg

SEQ ID NO: 18903 - RNA, 22 nt, Artificial Sequence
  Guide Sequence
caccugacuagggcccucagug

SEQ ID NO: 18904 - RNA, 22 nt, Artificial Sequence
  Guide Sequence
cacuacugcccccagcucguua

SEQ ID NO: 18905 - RNA, 22 nt, Artificial Sequence
  Guide Sequence
cacuggggccugcaugacccuu

SEQ ID NO: 18906 - RNA, 22 nt, Artificial Sequence
  Guide Sequence
cagagacaggagaaaggacagu

SEQ ID NO: 18907 - RNA, 22 nt, Artificial Sequence
  Guide Sequence
cagaggagggcugcccagagac

SEQ ID NO: 18908 - RNA, 22 nt, Artificial Sequence
  Guide Sequence
cagccaggagggaaggggcuga

SEQ ID NO: 18909 - RNA, 22 nt, Artificial Sequence
  Guide Sequence
cagcccagggugcugguggggu

SEQ ID NO: 18910 - RNA, 22 nt, Artificial Sequence
  Guide Sequence
cagcucccaggggggcucccac

SEQ ID NO: 18911 - RNA, 22 nt, Artificial Sequence
  Guide Sequence
cagcucguuagaaugcaccuga

SEQ ID NO: 18912 - RNA, 22 nt, Artificial Sequence
  Guide Sequence
caggaccugugcucacuggggc

SEQ ID NO: 18913 - RNA, 22 nt, Artificial Sequence
  Guide Sequence
caggagaaaggacaguccuguc

SEQ ID NO: 18914 - RNA, 22 nt, Artificial Sequence
  Guide Sequence
caggagggaaggggcugagaac

SEQ ID NO: 18915 - RNA, 22 nt, Artificial Sequence
  Guide Sequence
caggcuggcuguggugucucac

SEQ ID NO: 18916 - RNA, 22 nt, Artificial Sequence
  Guide Sequence
caggggggcucccacuacugcc

SEQ ID NO: 18917 - RNA, 22 nt, Artificial Sequence
  Guide Sequence
cagggugcugguggggucagag

SEQ ID NO: 18918 - RNA, 22 nt, Artificial Sequence
  Guide Sequence
cagguagacuuauuuccuucuc

SEQ ID NO: 18919 - RNA, 22 nt, Artificial Sequence
  Guide Sequence
caguccugucugacuuuuccug

SEQ ID NO: 18920 - RNA, 22 nt, Artificial Sequence
  Guide Sequence
cagugggacuuggcuggcggca

SEQ ID NO: 18921 - RNA, 22 nt, Artificial Sequence
  Guide Sequence
ccaauugauuuuucggggcuuu

SEQ ID NO: 18922 - RNA, 22 nt, Artificial Sequence
  Guide Sequence
ccacuacugcccccagcucguu

SEQ ID NO: 18923 - RNA, 22 nt, Artificial Sequence
  Guide Sequence
ccagagacaggagaaaggacag

SEQ ID NO: 18924 - RNA, 22 nt, Artificial Sequence
  Guide Sequence
ccagcucguuagaaugcaccug

SEQ ID NO: 18925 - RNA, 22 nt, Artificial Sequence
  Guide Sequence
ccaggagggaaggggcugagaa

SEQ ID NO: 18926 - RNA, 22 nt, Artificial Sequence
  Guide Sequence
ccaggggggcucccacuacugc

SEQ ID NO: 18927 - RNA, 22 nt, Artificial Sequence
  Guide Sequence
ccagggugcugguggggucaga

SEQ ID NO: 18928 - RNA, 22 nt, Artificial Sequence
  Guide Sequence
cccaagcauuuccaaagcccau

SEQ ID NO: 18929 - RNA, 22 nt, Artificial Sequence
  Guide Sequence
cccaauugauuuuucggggcuu

SEQ ID NO: 18930 - RNA, 22 nt, Artificial Sequence
  Guide Sequence
cccacuacugcccccagcucgu

SEQ ID NO: 18931 - RNA, 22 nt, Artificial Sequence
  Guide Sequence
cccagagacaggagaaaggaca

SEQ ID NO: 18932 - RNA, 22 nt, Artificial Sequence
  Guide Sequence
cccagcucguuagaaugcaccu

SEQ ID NO: 18933 - RNA, 22 nt, Artificial Sequence
  Guide Sequence
cccaggggggcucccacuacug

SEQ ID NO: 18934 - RNA, 22 nt, Artificial Sequence
  Guide Sequence
cccagggugcugguggggucag

SEQ ID NO: 18935 - RNA, 22 nt, Artificial Sequence
  Guide Sequence
ccccagcucguuagaaugcacc

SEQ ID NO: 18936 - RNA, 22 nt, Artificial Sequence
  Guide Sequence
cccccagcucguuagaaugcac

SEQ ID NO: 18937 - RNA, 22 nt, Artificial Sequence
  Guide Sequence
cccgucagcucccaggggggcu

SEQ ID NO: 18938 - RNA, 22 nt, Artificial Sequence
  Guide Sequence
cccucagugggacuuggcuggc

SEQ ID NO: 18939 - RNA, 22 nt, Artificial Sequence
  Guide Sequence
cccuuagucgcugcccaagcau

SEQ ID NO: 18940 - RNA, 22 nt, Artificial Sequence
  Guide Sequence
ccgucagcucccaggggggcuc

SEQ ID NO: 18941 - RNA, 22 nt, Artificial Sequence
  Guide Sequence
ccucagugggacuuggcuggcg

SEQ ID NO: 18942 - RNA, 22 nt, Artificial Sequence
  Guide Sequence
ccugacuagggcccucaguggg

SEQ ID NO: 18943 - RNA, 22 nt, Artificial Sequence
  Guide Sequence
ccugcguuugggguggggcugg

SEQ ID NO: 18944 - RNA, 22 nt, Artificial Sequence
  Guide Sequence
ccuggcucacagccaggaggga

SEQ ID NO: 18945 - RNA, 22 nt, Artificial Sequence
  Guide Sequence
ccugucugacuuuuccuguugg

SEQ ID NO: 18946 - RNA, 22 nt, Artificial Sequence
  Guide Sequence
ccugugcucacuggggccugca

SEQ ID NO: 18947 - RNA, 22 nt, Artificial Sequence
  Guide Sequence
ccuguuggugcugcuuagaaau

SEQ ID NO: 18948 - RNA, 22 nt, Artificial Sequence
  Guide Sequence
ccuuagucgcugcccaagcauu

SEQ ID NO: 18949 - RNA, 22 nt, Artificial Sequence
  Guide Sequence
ccuucucuggagggcacagccc

SEQ ID NO: 18950 - RNA, 22 nt, Artificial Sequence
  Guide Sequence
cgcugcccaagcauuuccaaag

SEQ ID NO: 18951 - RNA, 22 nt, Artificial Sequence
  Guide Sequence
cggggcuuuugaucuaaaugcu

SEQ ID NO: 18952 - RNA, 22 nt, Artificial Sequence
  Guide Sequence
cgucagcucccaggggggcucc

SEQ ID NO: 18953 - RNA, 22 nt, Artificial Sequence
  Guide Sequence
cguuaacuuuucccaauugauu

SEQ ID NO: 18954 - RNA, 22 nt, Artificial Sequence
  Guide Sequence
cguuagaaugcaccugacuagg

SEQ ID NO: 18955 - RNA, 22 nt, Artificial Sequence
  Guide Sequence
cguuugggguggggcugggucc

SEQ ID NO: 18956 - RNA, 22 nt, Artificial Sequence
  Guide Sequence
cuaaaugcuugcacaaacaaca

SEQ ID NO: 18957 - RNA, 22 nt, Artificial Sequence
  Guide Sequence
cuacugcccccagcucguuaga

SEQ ID NO: 18958 - RNA, 22 nt, Artificial Sequence
  Guide Sequence
cuagggcccucagugggacuug

SEQ ID NO: 18959 - RNA, 22 nt, Artificial Sequence
  Guide Sequence
cucacagccaggagggaagggg

SEQ ID NO: 18960 - RNA, 22 nt, Artificial Sequence
  Guide Sequence
cucaccccuguaaucccagcac

SEQ ID NO: 18961 - RNA, 22 nt, Artificial Sequence
  Guide Sequence
cucacuggggccugcaugaccc

SEQ ID NO: 18962 - RNA, 22 nt, Artificial Sequence
  Guide Sequence
cucagugggacuuggcuggcgg

SEQ ID NO: 18963 - RNA, 22 nt, Artificial Sequence
  Guide Sequence
cucccacuacugcccccagcuc

SEQ ID NO: 18964 - RNA, 22 nt, Artificial Sequence
  Guide Sequence
cucccaggggggcucccacuac

SEQ ID NO: 18965 - RNA, 22 nt, Artificial Sequence
  Guide Sequence
cucguuaacuuuucccaauuga

SEQ ID NO: 18966 - RNA, 22 nt, Artificial Sequence
  Guide Sequence
cucguuagaaugcaccugacua

SEQ ID NO: 18967 - RNA, 22 nt, Artificial Sequence
  Guide Sequence
cucuggagggcacagcccaggg

SEQ ID NO: 18968 - RNA, 22 nt, Artificial Sequence
  Guide Sequence
cugacuagggcccucaguggga

SEQ ID NO: 18969 - RNA, 22 nt, Artificial Sequence
  Guide Sequence
cugacuuuuccuguuggugcug

SEQ ID NO: 18970 - RNA, 22 nt, Artificial Sequence
  Guide Sequence
cugagaacaggaccugugcuca

SEQ ID NO: 18971 - RNA, 22 nt, Artificial Sequence
  Guide Sequence
cugcccaagcauuuccaaagcc

SEQ ID NO: 18972 - RNA, 22 nt, Artificial Sequence
  Guide Sequence
cugcccagagacaggagaaagg

SEQ ID NO: 18973 - RNA, 22 nt, Artificial Sequence
  Guide Sequence
cugcccccagcucguuagaaug

SEQ ID NO: 18974 - RNA, 22 nt, Artificial Sequence
  Guide Sequence
cugcguuugggguggggcuggg

SEQ ID NO: 18975 - RNA, 22 nt, Artificial Sequence
  Guide Sequence
cugcuuagaaauuuggaggcag

SEQ ID NO: 18976 - RNA, 22 nt, Artificial Sequence
  Guide Sequence
cuggagggcacagcccagggug

SEQ ID NO: 18977 - RNA, 22 nt, Artificial Sequence
  Guide Sequence
cuggcucacagccaggagggaa

SEQ ID NO: 18978 - RNA, 22 nt, Artificial Sequence
  Guide Sequence
cuggcuguggugucucaccccu

SEQ ID NO: 18979 - RNA, 22 nt, Artificial Sequence
  Guide Sequence
cuggggccugcaugacccuucc

SEQ ID NO: 18980 - RNA, 22 nt, Artificial Sequence
  Guide Sequence
cugggucccuuagucgcugccc

SEQ ID NO: 18981 - RNA, 22 nt, Artificial Sequence
  Guide Sequence
cugguggggucagaggagggcu

SEQ ID NO: 18982 - RNA, 22 nt, Artificial Sequence
  Guide Sequence
cugucugacuuuuccuguuggu

SEQ ID NO: 18983 - RNA, 22 nt, Artificial Sequence
  Guide Sequence
cugugcucacuggggccugcau

SEQ ID NO: 18984 - RNA, 22 nt, Artificial Sequence
  Guide Sequence
cuguggugucucaccccuguaa

SEQ ID NO: 18985 - RNA, 22 nt, Artificial Sequence
  Guide Sequence
cuguuggugcugcuuagaaauu

SEQ ID NO: 18986 - RNA, 22 nt, Artificial Sequence
  Guide Sequence
cuuagaaauuuggaggcaggcu

SEQ ID NO: 18987 - RNA, 22 nt, Artificial Sequence
  Guide Sequence
cuuagucgcugcccaagcauuu

SEQ ID NO: 18988 - RNA, 22 nt, Artificial Sequence
  Guide Sequence
cuuauuuccuucucuggagggc

SEQ ID NO: 18989 - RNA, 22 nt, Artificial Sequence
  Guide Sequence
cuucucuggagggcacagccca

SEQ ID NO: 18990 - RNA, 22 nt, Artificial Sequence
  Guide Sequence
cuugcacaaacaacaccccguc

SEQ ID NO: 18991 - RNA, 22 nt, Artificial Sequence
  Guide Sequence
cuuuucccaauugauuuuucgg

SEQ ID NO: 18992 - RNA, 22 nt, Artificial Sequence
  Guide Sequence
cuuuuccuguuggugcugcuua

SEQ ID NO: 18993 - RNA, 22 nt, Artificial Sequence
  Guide Sequence
cuuuugaucuaaaugcuugcac

SEQ ID NO: 18994 - RNA, 22 nt, Artificial Sequence
  Guide Sequence
gaaaggacaguccugucugacu

SEQ ID NO: 18995 - RNA, 22 nt, Artificial Sequence
  Guide Sequence
gaaauuuggaggcaggcuggcu

SEQ ID NO: 18996 - RNA, 22 nt, Artificial Sequence
  Guide Sequence
gaacaggaccugugcucacugg

SEQ ID NO: 18997 - RNA, 22 nt, Artificial Sequence
  Guide Sequence
gaagccuggcucacagccagga

SEQ ID NO: 18998 - RNA, 22 nt, Artificial Sequence
  Guide Sequence
gaaggggcugagaacaggaccu

SEQ ID NO: 18999 - RNA, 22 nt, Artificial Sequence
  Guide Sequence
gaaugcaccugacuagggcccu

SEQ ID NO: 19000 - RNA, 22 nt, Artificial Sequence
  Guide Sequence
gacaggagaaaggacaguccug

SEQ ID NO: 19001 - RNA, 22 nt, Artificial Sequence
  Guide Sequence
gacaguccugucugacuuuucc

SEQ ID NO: 19002 - RNA, 22 nt, Artificial Sequence
  Guide Sequence
gaccugugcucacuggggccug

SEQ ID NO: 19003 - RNA, 22 nt, Artificial Sequence
  Guide Sequence
gacuagggcccucagugggacu

SEQ ID NO: 19004 - RNA, 22 nt, Artificial Sequence
  Guide Sequence
gacuuauuuccuucucuggagg

SEQ ID NO: 19005 - RNA, 22 nt, Artificial Sequence
  Guide Sequence
gacuuuuccuguuggugcugcu

SEQ ID NO: 19006 - RNA, 22 nt, Artificial Sequence
  Guide Sequence
gagaaaggacaguccugucuga

SEQ ID NO: 19007 - RNA, 22 nt, Artificial Sequence
  Guide Sequence
gagaacaggaccugugcucacu

SEQ ID NO: 19008 - RNA, 22 nt, Artificial Sequence
  Guide Sequence
gagaagccuggcucacagccag

SEQ ID NO: 19009 - RNA, 22 nt, Artificial Sequence
  Guide Sequence
gagacaggagaaaggacagucc

SEQ ID NO: 19010 - RNA, 22 nt, Artificial Sequence
  Guide Sequence
gaggagggcugcccagagacag

SEQ ID NO: 19011 - RNA, 22 nt, Artificial Sequence
  Guide Sequence
gaggcaggcuggcugugguguc

SEQ ID NO: 19012 - RNA, 22 nt, Artificial Sequence
  Guide Sequence
gagggaaggggcugagaacagg

SEQ ID NO: 19013 - RNA, 22 nt, Artificial Sequence
  Guide Sequence
gagggcacagcccagggugcug

SEQ ID NO: 19014 - RNA, 22 nt, Artificial Sequence
  Guide Sequence
gagggcugcccagagacaggag

SEQ ID NO: 19015 - RNA, 22 nt, Artificial Sequence
  Guide Sequence
gaucuaaaugcuugcacaaaca

SEQ ID NO: 19016 - RNA, 22 nt, Artificial Sequence
  Guide Sequence
gauuuuucggggcuuuugaucu

SEQ ID NO: 19017 - RNA, 22 nt, Artificial Sequence
  Guide Sequence
gcacaaacaacaccccgucagc

SEQ ID NO: 19018 - RNA, 22 nt, Artificial Sequence
  Guide Sequence
gcacagcccagggugcuggugg

SEQ ID NO: 19019 - RNA, 22 nt, Artificial Sequence
  Guide Sequence
gcaccugacuagggcccucagu

SEQ ID NO: 19020 - RNA, 22 nt, Artificial Sequence
  Guide Sequence
gcaggcuggcuguggugucuca

SEQ ID NO: 19021 - RNA, 22 nt, Artificial Sequence
  Guide Sequence
gccaggagggaaggggcugaga

SEQ ID NO: 19022 - RNA, 22 nt, Artificial Sequence
  Guide Sequence
gcccaagcauuuccaaagccca

SEQ ID NO: 19023 - RNA, 22 nt, Artificial Sequence
  Guide Sequence
gcccagagacaggagaaaggac

SEQ ID NO: 19024 - RNA, 22 nt, Artificial Sequence
  Guide Sequence
gcccagggugcuggugggguca

SEQ ID NO: 19025 - RNA, 22 nt, Artificial Sequence
  Guide Sequence
gcccccagcucguuagaaugca

SEQ ID NO: 19026 - RNA, 22 nt, Artificial Sequence
  Guide Sequence
gcccucagugggacuuggcugg

SEQ ID NO: 19027 - RNA, 22 nt, Artificial Sequence
  Guide Sequence
gccugcaugacccuucccuccc

SEQ ID NO: 19028 - RNA, 22 nt, Artificial Sequence
  Guide Sequence
gccugcguuugggguggggcug

SEQ ID NO: 19029 - RNA, 22 nt, Artificial Sequence
  Guide Sequence
gccuggcucacagccaggaggg

SEQ ID NO: 19030 - RNA, 22 nt, Artificial Sequence
  Guide Sequence
gcguuugggguggggcuggguc

SEQ ID NO: 19031 - RNA, 22 nt, Artificial Sequence
  Guide Sequence
gcucacagccaggagggaaggg

SEQ ID NO: 19032 - RNA, 22 nt, Artificial Sequence
  Guide Sequence
gcucacuggggccugcaugacc

SEQ ID NO: 19033 - RNA, 22 nt, Artificial Sequence
  Guide Sequence
gcucccacuacugcccccagcu

SEQ ID NO: 19034 - RNA, 22 nt, Artificial Sequence
  Guide Sequence
gcucccaggggggcucccacua

SEQ ID NO: 19035 - RNA, 22 nt, Artificial Sequence
  Guide Sequence
gcucguuagaaugcaccugacu

SEQ ID NO: 19036 - RNA, 22 nt, Artificial Sequence
  Guide Sequence
gcugagaacaggaccugugcuc

SEQ ID NO: 19037 - RNA, 22 nt, Artificial Sequence
  Guide Sequence
gcugcccaagcauuuccaaagc

SEQ ID NO: 19038 - RNA, 22 nt, Artificial Sequence
  Guide Sequence
gcugcccagagacaggagaaag

SEQ ID NO: 19039 - RNA, 22 nt, Artificial Sequence
  Guide Sequence
gcugcuuagaaauuuggaggca

SEQ ID NO: 19040 - RNA, 22 nt, Artificial Sequence
  Guide Sequence
gcuggcuguggugucucacccc

SEQ ID NO: 19041 - RNA, 22 nt, Artificial Sequence
  Guide Sequence
gcugggucccuuagucgcugcc

SEQ ID NO: 19042 - RNA, 22 nt, Artificial Sequence
  Guide Sequence
gcugguggggucagaggagggc

SEQ ID NO: 19043 - RNA, 22 nt, Artificial Sequence
  Guide Sequence
gcuguggugucucaccccugua

SEQ ID NO: 19044 - RNA, 22 nt, Artificial Sequence
  Guide Sequence
gcuuagaaauuuggaggcaggc

SEQ ID NO: 19045 - RNA, 22 nt, Artificial Sequence
  Guide Sequence
gcuugcacaaacaacaccccgu

SEQ ID NO: 19046 - RNA, 22 nt, Artificial Sequence
  Guide Sequence
gcuuuugaucuaaaugcuugca

SEQ ID NO: 19047 - RNA, 22 nt, Artificial Sequence
  Guide Sequence
ggaaggggcugagaacaggacc

SEQ ID NO: 19048 - RNA, 22 nt, Artificial Sequence
  Guide Sequence
ggacaguccugucugacuuuuc

SEQ ID NO: 19049 - RNA, 22 nt, Artificial Sequence
  Guide Sequence
ggaccugugcucacuggggccu

SEQ ID NO: 19050 - RNA, 22 nt, Artificial Sequence
  Guide Sequence
ggagaaaggacaguccugucug

SEQ ID NO: 19051 - RNA, 22 nt, Artificial Sequence
  Guide Sequence
ggaggcaggcuggcuguggugu

SEQ ID NO: 19052 - RNA, 22 nt, Artificial Sequence
  Guide Sequence
ggagggaaggggcugagaacag

SEQ ID NO: 19053 - RNA, 22 nt, Artificial Sequence
  Guide Sequence
ggagggcacagcccagggugcu

SEQ ID NO: 19054 - RNA, 22 nt, Artificial Sequence
  Guide Sequence
ggagggcugcccagagacagga

SEQ ID NO: 19055 - RNA, 22 nt, Artificial Sequence
  Guide Sequence
ggcacagcccagggugcuggug

SEQ ID NO: 19056 - RNA, 22 nt, Artificial Sequence
  Guide Sequence
ggcaggcuggcuguggugucuc

SEQ ID NO: 19057 - RNA, 22 nt, Artificial Sequence
  Guide Sequence
ggcccucagugggacuuggcug

SEQ ID NO: 19058 - RNA, 22 nt, Artificial Sequence
  Guide Sequence
ggccugcaugacccuucccucc

SEQ ID NO: 19059 - RNA, 22 nt, Artificial Sequence
  Guide Sequence
ggccugcguuugggguggggcu

SEQ ID NO: 19060 - RNA, 22 nt, Artificial Sequence
  Guide Sequence
ggcucacagccaggagggaagg

SEQ ID NO: 19061 - RNA, 22 nt, Artificial Sequence
  Guide Sequence
ggcucccacuacugcccccagc

SEQ ID NO: 19062 - RNA, 22 nt, Artificial Sequence
  Guide Sequence
ggcugagaacaggaccugugcu

SEQ ID NO: 19063 - RNA, 22 nt, Artificial Sequence
  Guide Sequence
ggcugcccagagacaggagaaa

SEQ ID NO: 19064 - RNA, 22 nt, Artificial Sequence
  Guide Sequence
ggcuggcuguggugucucaccc

SEQ ID NO: 19065 - RNA, 22 nt, Artificial Sequence
  Guide Sequence
ggcugggucccuuagucgcugc

SEQ ID NO: 19066 - RNA, 22 nt, Artificial Sequence
  Guide Sequence
ggcuguggugucucaccccugu

SEQ ID NO: 19067 - RNA, 22 nt, Artificial Sequence
  Guide Sequence
ggcuuuugaucuaaaugcuugc

SEQ ID NO: 19068 - RNA, 22 nt, Artificial Sequence
  Guide Sequence
gggaaggggcugagaacaggac

SEQ ID NO: 19069 - RNA, 22 nt, Artificial Sequence
  Guide Sequence
gggacuuggcuggcggcaggug

SEQ ID NO: 19070 - RNA, 22 nt, Artificial Sequence
  Guide Sequence
gggcacagcccagggugcuggu

SEQ ID NO: 19071 - RNA, 22 nt, Artificial Sequence
  Guide Sequence
gggcccucagugggacuuggcu

SEQ ID NO: 19072 - RNA, 22 nt, Artificial Sequence
  Guide Sequence
gggccugcaugacccuucccuc

SEQ ID NO: 19073 - RNA, 22 nt, Artificial Sequence
  Guide Sequence
gggcucccacuacugcccccag

SEQ ID NO: 19074 - RNA, 22 nt, Artificial Sequence
  Guide Sequence
gggcugagaacaggaccugugc

SEQ ID NO: 19075 - RNA, 22 nt, Artificial Sequence
  Guide Sequence
gggcugcccagagacaggagaa

SEQ ID NO: 19076 - RNA, 22 nt, Artificial Sequence
  Guide Sequence
gggcugggucccuuagucgcug

SEQ ID NO: 19077 - RNA, 22 nt, Artificial Sequence
  Guide Sequence
gggcuuuugaucuaaaugcuug

SEQ ID NO: 19078 - RNA, 22 nt, Artificial Sequence
  Guide Sequence
ggggccugcaugacccuucccu

SEQ ID NO: 19079 - RNA, 22 nt, Artificial Sequence
  Guide Sequence
ggggcucccacuacugccccca

SEQ ID NO: 19080 - RNA, 22 nt, Artificial Sequence
  Guide Sequence
ggggcugagaacaggaccugug

SEQ ID NO: 19081 - RNA, 22 nt, Artificial Sequence
  Guide Sequence
ggggcugggucccuuagucgcu

SEQ ID NO: 19082 - RNA, 22 nt, Artificial Sequence
  Guide Sequence
ggggcuuuugaucuaaaugcuu

SEQ ID NO: 19083 - RNA, 22 nt, Artificial Sequence
  Guide Sequence
gggggcucccacuacugccccc

SEQ ID NO: 19084 - RNA, 22 nt, Artificial Sequence
  Guide Sequence
ggggggcucccacuacugcccc

SEQ ID NO: 19085 - RNA, 22 nt, Artificial Sequence
  Guide Sequence
ggggucagaggagggcugccca

SEQ ID NO: 19086 - RNA, 22 nt, Artificial Sequence
  Guide Sequence
gggguggggcugggucccuuag

SEQ ID NO: 19087 - RNA, 22 nt, Artificial Sequence
  Guide Sequence
gggucagaggagggcugcccag

SEQ ID NO: 19088 - RNA, 22 nt, Artificial Sequence
  Guide Sequence
gggucccuuagucgcugcccaa

SEQ ID NO: 19089 - RNA, 22 nt, Artificial Sequence
  Guide Sequence
gggugcugguggggucagagga

SEQ ID NO: 19090 - RNA, 22 nt, Artificial Sequence
  Guide Sequence
ggguggggcugggucccuuagu

SEQ ID NO: 19091 - RNA, 22 nt, Artificial Sequence
  Guide Sequence
gguaaggccugcguuuggggug

SEQ ID NO: 19092 - RNA, 22 nt, Artificial Sequence
  Guide Sequence
gguagacuuauuuccuucucug

SEQ ID NO: 19093 - RNA, 22 nt, Artificial Sequence
  Guide Sequence
ggucagaggagggcugcccaga

SEQ ID NO: 19094 - RNA, 22 nt, Artificial Sequence
  Guide Sequence
ggucccuuagucgcugcccaag

SEQ ID NO: 19095 - RNA, 22 nt, Artificial Sequence
  Guide Sequence
ggugcugcuuagaaauuuggag

SEQ ID NO: 19096 - RNA, 22 nt, Artificial Sequence
  Guide Sequence
ggugcugguggggucagaggag

SEQ ID NO: 19097 - RNA, 22 nt, Artificial Sequence
  Guide Sequence
gguggggcugggucccuuaguc

SEQ ID NO: 19098 - RNA, 22 nt, Artificial Sequence
  Guide Sequence
gguggggucagaggagggcugc

SEQ ID NO: 19099 - RNA, 22 nt, Artificial Sequence
  Guide Sequence
ggugucucaccccuguaauccc

SEQ ID NO: 19100 - RNA, 22 nt, Artificial Sequence
  Guide Sequence
guaaggccugcguuuggggugg

SEQ ID NO: 19101 - RNA, 22 nt, Artificial Sequence
  Guide Sequence
guagacuuauuuccuucucugg

SEQ ID NO: 19102 - RNA, 22 nt, Artificial Sequence
  Guide Sequence
gucagaggagggcugcccagag

SEQ ID NO: 19103 - RNA, 22 nt, Artificial Sequence
  Guide Sequence
gucagcucccaggggggcuccc

SEQ ID NO: 19104 - RNA, 22 nt, Artificial Sequence
  Guide Sequence
gucagguagacuuauuuccuuc

SEQ ID NO: 19105 - RNA, 22 nt, Artificial Sequence
  Guide Sequence
gucccuuagucgcugcccaagc

SEQ ID NO: 19106 - RNA, 22 nt, Artificial Sequence
  Guide Sequence
guccugucugacuuuuccuguu

SEQ ID NO: 19107 - RNA, 22 nt, Artificial Sequence
  Guide Sequence
gucgcugcccaagcauuuccaa

SEQ ID NO: 19108 - RNA, 22 nt, Artificial Sequence
  Guide Sequence
gucucaccccuguaaucccagc

SEQ ID NO: 19109 - RNA, 22 nt, Artificial Sequence
  Guide Sequence
gucugacuuuuccuguuggugc

SEQ ID NO: 19110 - RNA, 22 nt, Artificial Sequence
  Guide Sequence
gugcucacuggggccugcauga

SEQ ID NO: 19111 - RNA, 22 nt, Artificial Sequence
  Guide Sequence
gugcugcuuagaaauuuggagg

SEQ ID NO: 19112 - RNA, 22 nt, Artificial Sequence
  Guide Sequence
gugcugguggggucagaggagg

SEQ ID NO: 19113 - RNA, 22 nt, Artificial Sequence
  Guide Sequence
gugggacuuggcuggcggcagg

SEQ ID NO: 19114 - RNA, 22 nt, Artificial Sequence
  Guide Sequence
guggggcugggucccuuagucg

SEQ ID NO: 19115 - RNA, 22 nt, Artificial Sequence
  Guide Sequence
guggggucagaggagggcugcc

SEQ ID NO: 19116 - RNA, 22 nt, Artificial Sequence
  Guide Sequence
guggugucucaccccuguaauc

SEQ ID NO: 19117 - RNA, 22 nt, Artificial Sequence
  Guide Sequence
gugucucaccccuguaauccca

SEQ ID NO: 19118 - RNA, 22 nt, Artificial Sequence
  Guide Sequence
guuagaaugcaccugacuaggg

SEQ ID NO: 19119 - RNA, 22 nt, Artificial Sequence
  Guide Sequence
guuggugcugcuuagaaauuug

SEQ ID NO: 19120 - RNA, 22 nt, Artificial Sequence
  Guide Sequence
guuugggguggggcuggguccc

SEQ ID NO: 19121 - RNA, 22 nt, Artificial Sequence
  Guide Sequence
uaaaugcuugcacaaacaacac

SEQ ID NO: 19122 - RNA, 22 nt, Artificial Sequence
  Guide Sequence
uaaggccugcguuugggguggg

SEQ ID NO: 19123 - RNA, 22 nt, Artificial Sequence
  Guide Sequence
uacugcccccagcucguuagaa

SEQ ID NO: 19124 - RNA, 22 nt, Artificial Sequence
  Guide Sequence
uagaaauuuggaggcaggcugg

SEQ ID NO: 19125 - RNA, 22 nt, Artificial Sequence
  Guide Sequence
uagaaugcaccugacuagggcc

SEQ ID NO: 19126 - RNA, 22 nt, Artificial Sequence
  Guide Sequence
uagacuuauuuccuucucugga

SEQ ID NO: 19127 - RNA, 22 nt, Artificial Sequence
  Guide Sequence
uagggcccucagugggacuugg

SEQ ID NO: 19128 - RNA, 22 nt, Artificial Sequence
  Guide Sequence
uagucgcugcccaagcauuucc

SEQ ID NO: 19129 - RNA, 22 nt, Artificial Sequence
  Guide Sequence
uauuuccuucucuggagggcac

SEQ ID NO: 19130 - RNA, 22 nt, Artificial Sequence
  Guide Sequence
ucacagccaggagggaaggggc

SEQ ID NO: 19131 - RNA, 22 nt, Artificial Sequence
  Guide Sequence
ucaccccuguaaucccagcacu

SEQ ID NO: 19132 - RNA, 22 nt, Artificial Sequence
  Guide Sequence
ucacuggggccugcaugacccu

SEQ ID NO: 19133 - RNA, 22 nt, Artificial Sequence
  Guide Sequence
ucagaggagggcugcccagaga

SEQ ID NO: 19134 - RNA, 22 nt, Artificial Sequence
  Guide Sequence
ucagcucccaggggggcuccca

SEQ ID NO: 19135 - RNA, 22 nt, Artificial Sequence
  Guide Sequence
ucagguagacuuauuuccuucu

SEQ ID NO: 19136 - RNA, 22 nt, Artificial Sequence
  Guide Sequence
ucagugggacuuggcuggcggc

SEQ ID NO: 19137 - RNA, 22 nt, Artificial Sequence
  Guide Sequence
ucccaauugauuuuucggggcu

SEQ ID NO: 19138 - RNA, 22 nt, Artificial Sequence
  Guide Sequence
ucccacuacugcccccagcucg

SEQ ID NO: 19139 - RNA, 22 nt, Artificial Sequence
  Guide Sequence
ucccaggggggcucccacuacu

SEQ ID NO: 19140 - RNA, 22 nt, Artificial Sequence
  Guide Sequence
ucccuuagucgcugcccaagca

SEQ ID NO: 19141 - RNA, 22 nt, Artificial Sequence
  Guide Sequence
uccugucugacuuuuccuguug

SEQ ID NO: 19142 - RNA, 22 nt, Artificial Sequence
  Guide Sequence
uccuguuggugcugcuuagaaa

SEQ ID NO: 19143 - RNA, 22 nt, Artificial Sequence
  Guide Sequence
uccuucucuggagggcacagcc

SEQ ID NO: 19144 - RNA, 22 nt, Artificial Sequence
  Guide Sequence
ucgcugcccaagcauuuccaaa

SEQ ID NO: 19145 - RNA, 22 nt, Artificial Sequence
  Guide Sequence
ucggggcuuuugaucuaaaugc

SEQ ID NO: 19146 - RNA, 22 nt, Artificial Sequence
  Guide Sequence
ucguuaacuuuucccaauugau

SEQ ID NO: 19147 - RNA, 22 nt, Artificial Sequence
  Guide Sequence
ucguuagaaugcaccugacuag

SEQ ID NO: 19148 - RNA, 22 nt, Artificial Sequence
  Guide Sequence
ucuaaaugcuugcacaaacaac

SEQ ID NO: 19149 - RNA, 22 nt, Artificial Sequence
  Guide Sequence
ucucaccccuguaaucccagca

SEQ ID NO: 19150 - RNA, 22 nt, Artificial Sequence
  Guide Sequence
ucucuggagggcacagcccagg

SEQ ID NO: 19151 - RNA, 22 nt, Artificial Sequence
  Guide Sequence
ucugacuuuuccuguuggugcu

SEQ ID NO: 19152 - RNA, 22 nt, Artificial Sequence
  Guide Sequence
ucuggagggcacagcccagggu

SEQ ID NO: 19153 - RNA, 22 nt, Artificial Sequence
  Guide Sequence
ugacuagggcccucagugggac

SEQ ID NO: 19154 - RNA, 22 nt, Artificial Sequence
  Guide Sequence
ugacuuuuccuguuggugcugc

SEQ ID NO: 19155 - RNA, 22 nt, Artificial Sequence
  Guide Sequence
ugagaacaggaccugugcucac

SEQ ID NO: 19156 - RNA, 22 nt, Artificial Sequence
  Guide Sequence
ugagaagccuggcucacagcca

SEQ ID NO: 19157 - RNA, 22 nt, Artificial Sequence
  Guide Sequence
ugaucuaaaugcuugcacaaac

SEQ ID NO: 19158 - RNA, 22 nt, Artificial Sequence
  Guide Sequence
ugauuuuucggggcuuuugauc

SEQ ID NO: 19159 - RNA, 22 nt, Artificial Sequence
  Guide Sequence
ugcacaaacaacaccccgucag

SEQ ID NO: 19160 - RNA, 22 nt, Artificial Sequence
  Guide Sequence
ugcaccugacuagggcccucag

SEQ ID NO: 19161 - RNA, 22 nt, Artificial Sequence
  Guide Sequence
ugcccaagcauuuccaaagccc

SEQ ID NO: 19162 - RNA, 22 nt, Artificial Sequence
  Guide Sequence
ugcccagagacaggagaaagga

SEQ ID NO: 19163 - RNA, 22 nt, Artificial Sequence
  Guide Sequence
ugcccccagcucguuagaaugc

SEQ ID NO: 19164 - RNA, 22 nt, Artificial Sequence
  Guide Sequence
ugcguuugggguggggcugggu

SEQ ID NO: 19165 - RNA, 22 nt, Artificial Sequence
  Guide Sequence
ugcucacuggggccugcaugac

SEQ ID NO: 19166 - RNA, 22 nt, Artificial Sequence
  Guide Sequence
ugcugcuuagaaauuuggaggc

SEQ ID NO: 19167 - RNA, 22 nt, Artificial Sequence
  Guide Sequence
ugcugguggggucagaggaggg

SEQ ID NO: 19168 - RNA, 22 nt, Artificial Sequence
  Guide Sequence
ugcuuagaaauuuggaggcagg

SEQ ID NO: 19169 - RNA, 22 nt, Artificial Sequence
  Guide Sequence
ugcuugcacaaacaacaccccg

SEQ ID NO: 19170 - RNA, 22 nt, Artificial Sequence
  Guide Sequence
uggaggcaggcuggcuguggug

SEQ ID NO: 19171 - RNA, 22 nt, Artificial Sequence
  Guide Sequence
uggagggcacagcccagggugc

SEQ ID NO: 19172 - RNA, 22 nt, Artificial Sequence
  Guide Sequence
uggcucacagccaggagggaag

SEQ ID NO: 19173 - RNA, 22 nt, Artificial Sequence
  Guide Sequence
uggcuguggugucucaccccug

SEQ ID NO: 19174 - RNA, 22 nt, Artificial Sequence
  Guide Sequence
ugggacuuggcuggcggcaggu

SEQ ID NO: 19175 - RNA, 22 nt, Artificial Sequence
  Guide Sequence
uggggccugcaugacccuuccc

SEQ ID NO: 19176 - RNA, 22 nt, Artificial Sequence
  Guide Sequence
uggggcugggucccuuagucgc

SEQ ID NO: 19177 - RNA, 22 nt, Artificial Sequence
  Guide Sequence
uggggucagaggagggcugccc

SEQ ID NO: 19178 - RNA, 22 nt, Artificial Sequence
  Guide Sequence
ugggguggggcugggucccuua

SEQ ID NO: 19179 - RNA, 22 nt, Artificial Sequence
  Guide Sequence
ugggucccuuagucgcugccca

SEQ ID NO: 19180 - RNA, 22 nt, Artificial Sequence
  Guide Sequence
uggugcugcuuagaaauuugga

SEQ ID NO: 19181 - RNA, 22 nt, Artificial Sequence
  Guide Sequence
ugguggggucagaggagggcug

SEQ ID NO: 19182 - RNA, 22 nt, Artificial Sequence
  Guide Sequence
uggugucucaccccuguaaucc

SEQ ID NO: 19183 - RNA, 22 nt, Artificial Sequence
  Guide Sequence
ugucagguagacuuauuuccuu

SEQ ID NO: 19184 - RNA, 22 nt, Artificial Sequence
  Guide Sequence
ugucucaccccuguaaucccag

SEQ ID NO: 19185 - RNA, 22 nt, Artificial Sequence
  Guide Sequence
ugucugacuuuuccuguuggug

SEQ ID NO: 19186 - RNA, 22 nt, Artificial Sequence
  Guide Sequence
ugugcucacuggggccugcaug

SEQ ID NO: 19187 - RNA, 22 nt, Artificial Sequence
  Guide Sequence
uguggugucucaccccuguaau

SEQ ID NO: 19188 - RNA, 22 nt, Artificial Sequence
  Guide Sequence
uguuggugcugcuuagaaauuu

SEQ ID NO: 19189 - RNA, 22 nt, Artificial Sequence
  Guide Sequence
uuagaaauuuggaggcaggcug

SEQ ID NO: 19190 - RNA, 22 nt, Artificial Sequence
  Guide Sequence
uuagaaugcaccugacuagggc

SEQ ID NO: 19191 - RNA, 22 nt, Artificial Sequence
  Guide Sequence
uuagucgcugcccaagcauuuc

SEQ ID NO: 19192 - RNA, 22 nt, Artificial Sequence
  Guide Sequence
uuauuuccuucucuggagggca

SEQ ID NO: 19193 - RNA, 22 nt, Artificial Sequence
  Guide Sequence
uucccaauugauuuuucggggc

SEQ ID NO: 19194 - RNA, 22 nt, Artificial Sequence
  Guide Sequence
uuccuguuggugcugcuuagaa

SEQ ID NO: 19195 - RNA, 22 nt, Artificial Sequence
  Guide Sequence
uuccuucucuggagggcacagc

SEQ ID NO: 19196 - RNA, 22 nt, Artificial Sequence
  Guide Sequence
uucggggcuuuugaucuaaaug

SEQ ID NO: 19197 - RNA, 22 nt, Artificial Sequence
  Guide Sequence
uucucuggagggcacagcccag

SEQ ID NO: 19198 - RNA, 22 nt, Artificial Sequence
  Guide Sequence
uugagaagccuggcucacagcc

SEQ ID NO: 19199 - RNA, 22 nt, Artificial Sequence
  Guide Sequence
uugaucuaaaugcuugcacaaa

SEQ ID NO: 19200 - RNA, 22 nt, Artificial Sequence
  Guide Sequence
uugauuuuucggggcuuuugau

SEQ ID NO: 19201 - RNA, 22 nt, Artificial Sequence
  Guide Sequence
uugcacaaacaacaccccguca

SEQ ID NO: 19202 - RNA, 22 nt, Artificial Sequence
  Guide Sequence
uuggaggcaggcuggcuguggu

SEQ ID NO: 19203 - RNA, 22 nt, Artificial Sequence
  Guide Sequence
uugggguggggcugggucccuu

SEQ ID NO: 19204 - RNA, 22 nt, Artificial Sequence
  Guide Sequence
uuggugcugcuuagaaauuugg

SEQ ID NO: 19205 - RNA, 22 nt, Artificial Sequence
  Guide Sequence
uuucccaauugauuuuucgggg

SEQ ID NO: 19206 - RNA, 22 nt, Artificial Sequence
  Guide Sequence
uuuccuguuggugcugcuuaga

SEQ ID NO: 19207 - RNA, 22 nt, Artificial Sequence
  Guide Sequence
uuuccuucucuggagggcacag

SEQ ID NO: 19208 - RNA, 22 nt, Artificial Sequence
  Guide Sequence
uuucggggcuuuugaucuaaau

SEQ ID NO: 19209 - RNA, 22 nt, Artificial Sequence
  Guide Sequence
uuugagaagccuggcucacagc

SEQ ID NO: 19210 - RNA, 22 nt, Artificial Sequence
  Guide Sequence
uuugaucuaaaugcuugcacaa

SEQ ID NO: 19211 - RNA, 22 nt, Artificial Sequence
  Guide Sequence
uuuggaggcaggcuggcugugg

SEQ ID NO: 19212 - RNA, 22 nt, Artificial Sequence
  Guide Sequence
uuugggguggggcugggucccu

SEQ ID NO: 19213 - RNA, 22 nt, Artificial Sequence
  Guide Sequence
uuuucccaauugauuuuucggg

SEQ ID NO: 19214 - RNA, 22 nt, Artificial Sequence
  Guide Sequence
uuuuccuguuggugcugcuuag

SEQ ID NO: 19215 - RNA, 22 nt, Artificial Sequence
  Guide Sequence
uuuucggggcuuuugaucuaaa

SEQ ID NO: 19216 - RNA, 22 nt, Artificial Sequence
  Guide Sequence
uuuugaucuaaaugcuugcaca

SEQ ID NO: 19217 - RNA, 22 nt, Artificial Sequence
  Guide Sequence
uuuuucggggcuuuugaucuaa

SEQ ID NO: 19218 - RNA, 20 nt, Artificial Sequence
  Guide Sequence
aaaccacaaaucggggugcc

SEQ ID NO: 19219 - RNA, 20 nt, Artificial Sequence
  Guide Sequence
aaaggugugagccacugugc

SEQ ID NO: 19220 - RNA, 20 nt, Artificial Sequence
  Guide Sequence
aaagugccccagcagagacc

SEQ ID NO: 19221 - RNA, 20 nt, Artificial Sequence
  Guide Sequence
aaagugcugggauuacaagu

SEQ ID NO: 19222 - RNA, 20 nt, Artificial Sequence
  Guide Sequence
aaaucggggugcccaccugu

SEQ ID NO: 19223 - RNA, 20 nt, Artificial Sequence
  Guide Sequence
aaaugauucuccugccucag

SEQ ID NO: 19224 - RNA, 20 nt, Artificial Sequence
  Guide Sequence
aaaugggggaauacccacag

SEQ ID NO: 19225 - RNA, 20 nt, Artificial Sequence
  Guide Sequence
aaccacaaaucggggugccc

SEQ ID NO: 19226 - RNA, 20 nt, Artificial Sequence
  Guide Sequence
aagaggcgcuuccucccuuc

SEQ ID NO: 19227 - RNA, 20 nt, Artificial Sequence
  Guide Sequence
aaggugugagccacugugcc

SEQ ID NO: 19228 - RNA, 20 nt, Artificial Sequence
  Guide Sequence
aagugccccagcagagaccc

SEQ ID NO: 19229 - RNA, 20 nt, Artificial Sequence
  Guide Sequence
aagugcugggauuacaagug

SEQ ID NO: 19230 - RNA, 20 nt, Artificial Sequence
  Guide Sequence
aagugugagccacugugccu

SEQ ID NO: 19231 - RNA, 20 nt, Artificial Sequence
  Guide Sequence
aauacccacagugagaauua

SEQ ID NO: 19232 - RNA, 20 nt, Artificial Sequence
  Guide Sequence
aaucggggugcccaccugug

SEQ ID NO: 19233 - RNA, 20 nt, Artificial Sequence
  Guide Sequence
aaucuccgccuucuggguuc

SEQ ID NO: 19234 - RNA, 20 nt, Artificial Sequence
  Guide Sequence
aaugauucuccugccucagc

SEQ ID NO: 19235 - RNA, 20 nt, Artificial Sequence
  Guide Sequence
aaugggggaauacccacagu

SEQ ID NO: 19236 - RNA, 20 nt, Artificial Sequence
  Guide Sequence
aauuagaugagauagaugca

SEQ ID NO: 19237 - RNA, 20 nt, Artificial Sequence
  Guide Sequence
acaaagugccccagcagaga

SEQ ID NO: 19238 - RNA, 20 nt, Artificial Sequence
  Guide Sequence
acaaaucggggugcccaccu

SEQ ID NO: 19239 - RNA, 20 nt, Artificial Sequence
  Guide Sequence
acaagugugagccacugugc

SEQ ID NO: 19240 - RNA, 20 nt, Artificial Sequence
  Guide Sequence
acagugagaauuagaugaga

SEQ ID NO: 19241 - RNA, 20 nt, Artificial Sequence
  Guide Sequence
accacaaaucggggugccca

SEQ ID NO: 19242 - RNA, 20 nt, Artificial Sequence
  Guide Sequence
acccacagugagaauuagau

SEQ ID NO: 19243 - RNA, 20 nt, Artificial Sequence
  Guide Sequence
acccccuugacuaacuuuua

SEQ ID NO: 19244 - RNA, 20 nt, Artificial Sequence
  Guide Sequence
accugccucggccuuccaga

SEQ ID NO: 19245 - RNA, 20 nt, Artificial Sequence
  Guide Sequence
accugugguggguaguuagg

SEQ ID NO: 19246 - RNA, 20 nt, Artificial Sequence
  Guide Sequence
acgucugugaaaugggggaa

SEQ ID NO: 19247 - RNA, 20 nt, Artificial Sequence
  Guide Sequence
acugcaaucuccgccuucug

SEQ ID NO: 19248 - RNA, 20 nt, Artificial Sequence
  Guide Sequence
acugugccuggccacucccu

SEQ ID NO: 19249 - RNA, 20 nt, Artificial Sequence
  Guide Sequence
acugugccuggucugguuug

SEQ ID NO: 19250 - RNA, 20 nt, Artificial Sequence
  Guide Sequence
agaauuagaugagauagaug

SEQ ID NO: 19251 - RNA, 20 nt, Artificial Sequence
  Guide Sequence
agacccccuugacuaacuuu

SEQ ID NO: 19252 - RNA, 20 nt, Artificial Sequence
  Guide Sequence
agagacccccuugacuaacu

SEQ ID NO: 19253 - RNA, 20 nt, Artificial Sequence
  Guide Sequence
agaggcgcuuccucccuucc

SEQ ID NO: 19254 - RNA, 20 nt, Artificial Sequence
  Guide Sequence
agagugcugggauuaaaggu

SEQ ID NO: 19255 - RNA, 20 nt, Artificial Sequence
  Guide Sequence
agauagaugcauuugaaacc

SEQ ID NO: 19256 - RNA, 20 nt, Artificial Sequence
  Guide Sequence
agaugagauagaugcauuug

SEQ ID NO: 19257 - RNA, 20 nt, Artificial Sequence
  Guide Sequence
agaugcauuugaaaccacaa

SEQ ID NO: 19258 - RNA, 20 nt, Artificial Sequence
  Guide Sequence
agcagagacccccuugacua

SEQ ID NO: 19259 - RNA, 20 nt, Artificial Sequence
  Guide Sequence
agccacugugccuggccacu

SEQ ID NO: 19260 - RNA, 20 nt, Artificial Sequence
  Guide Sequence
agccacugugccuggucugg

SEQ ID NO: 19261 - RNA, 20 nt, Artificial Sequence
  Guide Sequence
agccucccaaagugcuggga

SEQ ID NO: 19262 - RNA, 20 nt, Artificial Sequence
  Guide Sequence
agcucacugcaaucuccgcc

SEQ ID NO: 19263 - RNA, 20 nt, Artificial Sequence
  Guide Sequence
agcuguuacaaagugcccca

SEQ ID NO: 19264 - RNA, 20 nt, Artificial Sequence
  Guide Sequence
aggaagaggcgcuuccuccc

SEQ ID NO: 19265 - RNA, 20 nt, Artificial Sequence
  Guide Sequence
aggcgcuuccucccuucccu

SEQ ID NO: 19266 - RNA, 20 nt, Artificial Sequence
  Guide Sequence
aggcuggagugcaguggcgc

SEQ ID NO: 19267 - RNA, 20 nt, Artificial Sequence
  Guide Sequence
aggggcaugaggaagaggcg

SEQ ID NO: 19268 - RNA, 20 nt, Artificial Sequence
  Guide Sequence
agguagcuguuacaaagugc

SEQ ID NO: 19269 - RNA, 20 nt, Artificial Sequence
  Guide Sequence
aggugugagccacugugccu

SEQ ID NO: 19270 - RNA, 20 nt, Artificial Sequence
  Guide Sequence
agucucuugcucugucgccc

SEQ ID NO: 19271 - RNA, 20 nt, Artificial Sequence
  Guide Sequence
agugagaauuagaugagaua

SEQ ID NO: 19272 - RNA, 20 nt, Artificial Sequence
  Guide Sequence
agugcaguggcgccaucuca

SEQ ID NO: 19273 - RNA, 20 nt, Artificial Sequence
  Guide Sequence
agugccccagcagagacccc

SEQ ID NO: 19274 - RNA, 20 nt, Artificial Sequence
  Guide Sequence
agugcugggauuaaaggugu

SEQ ID NO: 19275 - RNA, 20 nt, Artificial Sequence
  Guide Sequence
agugcugggauuacaagugu

SEQ ID NO: 19276 - RNA, 20 nt, Artificial Sequence
  Guide Sequence
aguggcgccaucucagcuca

SEQ ID NO: 19277 - RNA, 20 nt, Artificial Sequence
  Guide Sequence
agugugagccacugugccug

SEQ ID NO: 19278 - RNA, 20 nt, Artificial Sequence
  Guide Sequence
aguuagguagcuguuacaaa

SEQ ID NO: 19279 - RNA, 20 nt, Artificial Sequence
  Guide Sequence
aguuuccacgucugugaaau

SEQ ID NO: 19280 - RNA, 20 nt, Artificial Sequence
  Guide Sequence
auacccacagugagaauuag

SEQ ID NO: 19281 - RNA, 20 nt, Artificial Sequence
  Guide Sequence
auagaugcauuugaaaccac

SEQ ID NO: 19282 - RNA, 20 nt, Artificial Sequence
  Guide Sequence
auccaccugccucggccuuc

SEQ ID NO: 19283 - RNA, 20 nt, Artificial Sequence
  Guide Sequence
auccuggucugggucucuuu

SEQ ID NO: 19284 - RNA, 20 nt, Artificial Sequence
  Guide Sequence
aucggggugcccaccugugg

SEQ ID NO: 19285 - RNA, 20 nt, Artificial Sequence
  Guide Sequence
aucucagcucacugcaaucu

SEQ ID NO: 19286 - RNA, 20 nt, Artificial Sequence
  Guide Sequence
aucuccgccuucuggguuca

SEQ ID NO: 19287 - RNA, 20 nt, Artificial Sequence
  Guide Sequence
augagauagaugcauuugaa

SEQ ID NO: 19288 - RNA, 20 nt, Artificial Sequence
  Guide Sequence
augaggaagaggcgcuuccu

SEQ ID NO: 19289 - RNA, 20 nt, Artificial Sequence
  Guide Sequence
augauucuccugccucagcc

SEQ ID NO: 19290 - RNA, 20 nt, Artificial Sequence
  Guide Sequence
augcauuugaaaccacaaau

SEQ ID NO: 19291 - RNA, 20 nt, Artificial Sequence
  Guide Sequence
augggggaauacccacagug

SEQ ID NO: 19292 - RNA, 20 nt, Artificial Sequence
  Guide Sequence
auuaaaggugugagccacug

SEQ ID NO: 19293 - RNA, 20 nt, Artificial Sequence
  Guide Sequence
auuacaagugugagccacug

SEQ ID NO: 19294 - RNA, 20 nt, Artificial Sequence
  Guide Sequence
auuagaugagauagaugcau

SEQ ID NO: 19295 - RNA, 20 nt, Artificial Sequence
  Guide Sequence
auucuccugccucagccucc

SEQ ID NO: 19296 - RNA, 20 nt, Artificial Sequence
  Guide Sequence
auuguucuucaggggcauga

SEQ ID NO: 19297 - RNA, 20 nt, Artificial Sequence
  Guide Sequence
auuugaaaccacaaaucggg

SEQ ID NO: 19298 - RNA, 20 nt, Artificial Sequence
  Guide Sequence
caaagugccccagcagagac

SEQ ID NO: 19299 - RNA, 20 nt, Artificial Sequence
  Guide Sequence
caaagugcugggauuacaag

SEQ ID NO: 19300 - RNA, 20 nt, Artificial Sequence
  Guide Sequence
caaaucggggugcccaccug

SEQ ID NO: 19301 - RNA, 20 nt, Artificial Sequence
  Guide Sequence
caaaugauucuccugccuca

SEQ ID NO: 19302 - RNA, 20 nt, Artificial Sequence
  Guide Sequence
caagugugagccacugugcc

SEQ ID NO: 19303 - RNA, 20 nt, Artificial Sequence
  Guide Sequence
caaucuccgccuucuggguu

SEQ ID NO: 19304 - RNA, 20 nt, Artificial Sequence
  Guide Sequence
cacaaaucggggugcccacc

SEQ ID NO: 19305 - RNA, 20 nt, Artificial Sequence
  Guide Sequence
cacagugagaauuagaugag

SEQ ID NO: 19306 - RNA, 20 nt, Artificial Sequence
  Guide Sequence
caccugccucggccuuccag

SEQ ID NO: 19307 - RNA, 20 nt, Artificial Sequence
  Guide Sequence
caccugugguggguaguuag

SEQ ID NO: 19308 - RNA, 20 nt, Artificial Sequence
  Guide Sequence
cacgucugugaaauggggga

SEQ ID NO: 19309 - RNA, 20 nt, Artificial Sequence
  Guide Sequence
cacugcaaucuccgccuucu

SEQ ID NO: 19310 - RNA, 20 nt, Artificial Sequence
  Guide Sequence
cacugugccuggccacuccc

SEQ ID NO: 19311 - RNA, 20 nt, Artificial Sequence
  Guide Sequence
cacugugccuggucugguuu

SEQ ID NO: 19312 - RNA, 20 nt, Artificial Sequence
  Guide Sequence
cagagacccccuugacuaac

SEQ ID NO: 19313 - RNA, 20 nt, Artificial Sequence
  Guide Sequence
cagagugcugggauuaaagg

SEQ ID NO: 19314 - RNA, 20 nt, Artificial Sequence
  Guide Sequence
cagcagagacccccuugacu

SEQ ID NO: 19315 - RNA, 20 nt, Artificial Sequence
  Guide Sequence
cagccucccaaagugcuggg

SEQ ID NO: 19316 - RNA, 20 nt, Artificial Sequence
  Guide Sequence
cagcucacugcaaucuccgc

SEQ ID NO: 19317 - RNA, 20 nt, Artificial Sequence
  Guide Sequence
caggcuggagugcaguggcg

SEQ ID NO: 19318 - RNA, 20 nt, Artificial Sequence
  Guide Sequence
caggggcaugaggaagaggc

SEQ ID NO: 19319 - RNA, 20 nt, Artificial Sequence
  Guide Sequence
cagugagaauuagaugagau

SEQ ID NO: 19320 - RNA, 20 nt, Artificial Sequence
  Guide Sequence
caguggcgccaucucagcuc

SEQ ID NO: 19321 - RNA, 20 nt, Artificial Sequence
  Guide Sequence
caguuuccacgucugugaaa

SEQ ID NO: 19322 - RNA, 20 nt, Artificial Sequence
  Guide Sequence
caucucagcucacugcaauc

SEQ ID NO: 19323 - RNA, 20 nt, Artificial Sequence
  Guide Sequence
caugaggaagaggcgcuucc

SEQ ID NO: 19324 - RNA, 20 nt, Artificial Sequence
  Guide Sequence
cauuugaaaccacaaaucgg

SEQ ID NO: 19325 - RNA, 20 nt, Artificial Sequence
  Guide Sequence
ccaaagugcugggauuacaa

SEQ ID NO: 19326 - RNA, 20 nt, Artificial Sequence
  Guide Sequence
ccacaaaucggggugcccac

SEQ ID NO: 19327 - RNA, 20 nt, Artificial Sequence
  Guide Sequence
ccacagugagaauuagauga

SEQ ID NO: 19328 - RNA, 20 nt, Artificial Sequence
  Guide Sequence
ccaccugccucggccuucca

SEQ ID NO: 19329 - RNA, 20 nt, Artificial Sequence
  Guide Sequence
ccaccugugguggguaguua

SEQ ID NO: 19330 - RNA, 20 nt, Artificial Sequence
  Guide Sequence
ccacgucugugaaauggggg

SEQ ID NO: 19331 - RNA, 20 nt, Artificial Sequence
  Guide Sequence
ccacugugccuggccacucc

SEQ ID NO: 19332 - RNA, 20 nt, Artificial Sequence
  Guide Sequence
ccacugugccuggucugguu

SEQ ID NO: 19333 - RNA, 20 nt, Artificial Sequence
  Guide Sequence
ccagagugcugggauuaaag

SEQ ID NO: 19334 - RNA, 20 nt, Artificial Sequence
  Guide Sequence
ccagcagagacccccuugac

SEQ ID NO: 19335 - RNA, 20 nt, Artificial Sequence
  Guide Sequence
ccaggcuggagugcaguggc

SEQ ID NO: 19336 - RNA, 20 nt, Artificial Sequence
  Guide Sequence
ccaucucagcucacugcaau

SEQ ID NO: 19337 - RNA, 20 nt, Artificial Sequence
  Guide Sequence
cccacagugagaauuagaug

SEQ ID NO: 19338 - RNA, 20 nt, Artificial Sequence
  Guide Sequence
cccaccugugguggguaguu

SEQ ID NO: 19339 - RNA, 20 nt, Artificial Sequence
  Guide Sequence
cccagcagagacccccuuga

SEQ ID NO: 19340 - RNA, 20 nt, Artificial Sequence
  Guide Sequence
cccaggcuggagugcagugg

SEQ ID NO: 19341 - RNA, 20 nt, Artificial Sequence
  Guide Sequence
ccccagcagagacccccuug

SEQ ID NO: 19342 - RNA, 20 nt, Artificial Sequence
  Guide Sequence
cccccuugacuaacuuuuau

SEQ ID NO: 19343 - RNA, 20 nt, Artificial Sequence
  Guide Sequence
ccccuugacuaacuuuuauu

SEQ ID NO: 19344 - RNA, 20 nt, Artificial Sequence
  Guide Sequence
cccuucccuugggugagggg

SEQ ID NO: 19345 - RNA, 20 nt, Artificial Sequence
  Guide Sequence
cccuugacuaacuuuuauuc

SEQ ID NO: 19346 - RNA, 20 nt, Artificial Sequence
  Guide Sequence
cccuugggugagggggccca

SEQ ID NO: 19347 - RNA, 20 nt, Artificial Sequence
  Guide Sequence
ccgccuucuggguucaaaug

SEQ ID NO: 19348 - RNA, 20 nt, Artificial Sequence
  Guide Sequence
ccucagccucccaaagugcu

SEQ ID NO: 19349 - RNA, 20 nt, Artificial Sequence
  Guide Sequence
ccucccaaagugcugggauu

SEQ ID NO: 19350 - RNA, 20 nt, Artificial Sequence
  Guide Sequence
ccucccuucccuugggugag

SEQ ID NO: 19351 - RNA, 20 nt, Artificial Sequence
  Guide Sequence
ccucggccuuccagagugcu

SEQ ID NO: 19352 - RNA, 20 nt, Artificial Sequence
  Guide Sequence
ccugccucagccucccaaag

SEQ ID NO: 19353 - RNA, 20 nt, Artificial Sequence
  Guide Sequence
ccugccucggccuuccagag

SEQ ID NO: 19354 - RNA, 20 nt, Artificial Sequence
  Guide Sequence
ccuggucugggucucuuuuu

SEQ ID NO: 19355 - RNA, 20 nt, Artificial Sequence
  Guide Sequence
ccuggucugguuugggucuc

SEQ ID NO: 19356 - RNA, 20 nt, Artificial Sequence
  Guide Sequence
ccugugguggguaguuaggu

SEQ ID NO: 19357 - RNA, 20 nt, Artificial Sequence
  Guide Sequence
ccuuccagagugcugggauu

SEQ ID NO: 19358 - RNA, 20 nt, Artificial Sequence
  Guide Sequence
ccuucccuugggugaggggg

SEQ ID NO: 19359 - RNA, 20 nt, Artificial Sequence
  Guide Sequence
ccuucuggguucaaaugauu

SEQ ID NO: 19360 - RNA, 20 nt, Artificial Sequence
  Guide Sequence
ccuugacuaacuuuuauucu

SEQ ID NO: 19361 - RNA, 20 nt, Artificial Sequence
  Guide Sequence
ccuugggugagggggcccag

SEQ ID NO: 19362 - RNA, 20 nt, Artificial Sequence
  Guide Sequence
cgccaucucagcucacugca

SEQ ID NO: 19363 - RNA, 20 nt, Artificial Sequence
  Guide Sequence
cgcccaggcuggagugcagu

SEQ ID NO: 19364 - RNA, 20 nt, Artificial Sequence
  Guide Sequence
cgccuucuggguucaaauga

SEQ ID NO: 19365 - RNA, 20 nt, Artificial Sequence
  Guide Sequence
cgcuuccucccuucccuugg

SEQ ID NO: 19366 - RNA, 20 nt, Artificial Sequence
  Guide Sequence
cggccuuccagagugcuggg

SEQ ID NO: 19367 - RNA, 20 nt, Artificial Sequence
  Guide Sequence
cggggugcccaccuguggug

SEQ ID NO: 19368 - RNA, 20 nt, Artificial Sequence
  Guide Sequence
cgucugugaaaugggggaau

SEQ ID NO: 19369 - RNA, 20 nt, Artificial Sequence
  Guide Sequence
cuaacuuuuauucuuccauc

SEQ ID NO: 19370 - RNA, 20 nt, Artificial Sequence
  Guide Sequence
cucacugcaaucuccgccuu

SEQ ID NO: 19371 - RNA, 20 nt, Artificial Sequence
  Guide Sequence
cucagccucccaaagugcug

SEQ ID NO: 19372 - RNA, 20 nt, Artificial Sequence
  Guide Sequence
cucagcucacugcaaucucc

SEQ ID NO: 19373 - RNA, 20 nt, Artificial Sequence
  Guide Sequence
cucccaaagugcugggauua

SEQ ID NO: 19374 - RNA, 20 nt, Artificial Sequence
  Guide Sequence
cucccuucccuugggugagg

SEQ ID NO: 19375 - RNA, 20 nt, Artificial Sequence
  Guide Sequence
cuccgccuucuggguucaaa

SEQ ID NO: 19376 - RNA, 20 nt, Artificial Sequence
  Guide Sequence
cuccugccucagccucccaa

SEQ ID NO: 19377 - RNA, 20 nt, Artificial Sequence
  Guide Sequence
cucggccuuccagagugcug

SEQ ID NO: 19378 - RNA, 20 nt, Artificial Sequence
  Guide Sequence
cucugucgcccaggcuggag

SEQ ID NO: 19379 - RNA, 20 nt, Artificial Sequence
  Guide Sequence
cucuugauuguucuucaggg

SEQ ID NO: 19380 - RNA, 20 nt, Artificial Sequence
  Guide Sequence
cucuugcucugucgcccagg

SEQ ID NO: 19381 - RNA, 20 nt, Artificial Sequence
  Guide Sequence
cucuuuuuugagucucuugc

SEQ ID NO: 19382 - RNA, 20 nt, Artificial Sequence
  Guide Sequence
cugcaaucuccgccuucugg

SEQ ID NO: 19383 - RNA, 20 nt, Artificial Sequence
  Guide Sequence
cugccucagccucccaaagu

SEQ ID NO: 19384 - RNA, 20 nt, Artificial Sequence
  Guide Sequence
cugccucggccuuccagagu

SEQ ID NO: 19385 - RNA, 20 nt, Artificial Sequence
  Guide Sequence
cuggagugcaguggcgccau

SEQ ID NO: 19386 - RNA, 20 nt, Artificial Sequence
  Guide Sequence
cugggauuaaaggugugagc

SEQ ID NO: 19387 - RNA, 20 nt, Artificial Sequence
  Guide Sequence
cugggauuacaagugugagc

SEQ ID NO: 19388 - RNA, 20 nt, Artificial Sequence
  Guide Sequence
cugggucucuuuuuugaguc

SEQ ID NO: 19389 - RNA, 20 nt, Artificial Sequence
  Guide Sequence
cuggguucaaaugauucucc

SEQ ID NO: 19390 - RNA, 20 nt, Artificial Sequence
  Guide Sequence
cuggucugggucucuuuuuu

SEQ ID NO: 19391 - RNA, 20 nt, Artificial Sequence
  Guide Sequence
cuggucugguuugggucucu

SEQ ID NO: 19392 - RNA, 20 nt, Artificial Sequence
  Guide Sequence
cugguuugggucucuugauu

SEQ ID NO: 19393 - RNA, 20 nt, Artificial Sequence
  Guide Sequence
cugucgcccaggcuggagug

SEQ ID NO: 19394 - RNA, 20 nt, Artificial Sequence
  Guide Sequence
cugugaaaugggggaauacc

SEQ ID NO: 19395 - RNA, 20 nt, Artificial Sequence
  Guide Sequence
cugugccuggccacucccuu

SEQ ID NO: 19396 - RNA, 20 nt, Artificial Sequence
  Guide Sequence
cugugccuggucugguuugg

SEQ ID NO: 19397 - RNA, 20 nt, Artificial Sequence
  Guide Sequence
cugugguggguaguuaggua

SEQ ID NO: 19398 - RNA, 20 nt, Artificial Sequence
  Guide Sequence
cuguuacaaagugccccagc

SEQ ID NO: 19399 - RNA, 20 nt, Artificial Sequence
  Guide Sequence
cuucaggggcaugaggaaga

SEQ ID NO: 19400 - RNA, 20 nt, Artificial Sequence
  Guide Sequence
cuuccagagugcugggauua

SEQ ID NO: 19401 - RNA, 20 nt, Artificial Sequence
  Guide Sequence
cuucccuugggugagggggc

SEQ ID NO: 19402 - RNA, 20 nt, Artificial Sequence
  Guide Sequence
cuuccucccuucccuugggu

SEQ ID NO: 19403 - RNA, 20 nt, Artificial Sequence
  Guide Sequence
cuucuggguucaaaugauuc

SEQ ID NO: 19404 - RNA, 20 nt, Artificial Sequence
  Guide Sequence
cuugauuguucuucaggggc

SEQ ID NO: 19405 - RNA, 20 nt, Artificial Sequence
  Guide Sequence
cuugcucugucgcccaggcu

SEQ ID NO: 19406 - RNA, 20 nt, Artificial Sequence
  Guide Sequence
cuugggugagggggcccagg

SEQ ID NO: 19407 - RNA, 20 nt, Artificial Sequence
  Guide Sequence
cuuuuuugagucucuugcuc

SEQ ID NO: 19408 - RNA, 20 nt, Artificial Sequence
  Guide Sequence
gaaaccacaaaucggggugc

SEQ ID NO: 19409 - RNA, 20 nt, Artificial Sequence
  Guide Sequence
gaaaugggggaauacccaca

SEQ ID NO: 19410 - RNA, 20 nt, Artificial Sequence
  Guide Sequence
gaagaggcgcuuccucccuu

SEQ ID NO: 19411 - RNA, 20 nt, Artificial Sequence
  Guide Sequence
gaauacccacagugagaauu

SEQ ID NO: 19412 - RNA, 20 nt, Artificial Sequence
  Guide Sequence
gaauuagaugagauagaugc

SEQ ID NO: 19413 - RNA, 20 nt, Artificial Sequence
  Guide Sequence
gacccccuugacuaacuuuu

SEQ ID NO: 19414 - RNA, 20 nt, Artificial Sequence
  Guide Sequence
gacuaacuuuuauucuucca

SEQ ID NO: 19415 - RNA, 20 nt, Artificial Sequence
  Guide Sequence
gagaauuagaugagauagau

SEQ ID NO: 19416 - RNA, 20 nt, Artificial Sequence
  Guide Sequence
gagacccccuugacuaacuu

SEQ ID NO: 19417 - RNA, 20 nt, Artificial Sequence
  Guide Sequence
gagauagaugcauuugaaac

SEQ ID NO: 19418 - RNA, 20 nt, Artificial Sequence
  Guide Sequence
gagccacugugccuggccac

SEQ ID NO: 19419 - RNA, 20 nt, Artificial Sequence
  Guide Sequence
gagccacugugccuggucug

SEQ ID NO: 19420 - RNA, 20 nt, Artificial Sequence
  Guide Sequence
gaggaagaggcgcuuccucc

SEQ ID NO: 19421 - RNA, 20 nt, Artificial Sequence
  Guide Sequence
gaggcgcuuccucccuuccc

SEQ ID NO: 19422 - RNA, 20 nt, Artificial Sequence
  Guide Sequence
gagucucuugcucugucgcc

SEQ ID NO: 19423 - RNA, 20 nt, Artificial Sequence
  Guide Sequence
gagugcaguggcgccaucuc

SEQ ID NO: 19424 - RNA, 20 nt, Artificial Sequence
  Guide Sequence
gagugcugggauuaaaggug

SEQ ID NO: 19425 - RNA, 20 nt, Artificial Sequence
  Guide Sequence
gauagaugcauuugaaacca

SEQ ID NO: 19426 - RNA, 20 nt, Artificial Sequence
  Guide Sequence
gauccaccugccucggccuu

SEQ ID NO: 19427 - RNA, 20 nt, Artificial Sequence
  Guide Sequence
gaugagauagaugcauuuga

SEQ ID NO: 19428 - RNA, 20 nt, Artificial Sequence
  Guide Sequence
gaugcauuugaaaccacaaa

SEQ ID NO: 19429 - RNA, 20 nt, Artificial Sequence
  Guide Sequence
gauuaaaggugugagccacu

SEQ ID NO: 19430 - RNA, 20 nt, Artificial Sequence
  Guide Sequence
gauuacaagugugagccacu

SEQ ID NO: 19431 - RNA, 20 nt, Artificial Sequence
  Guide Sequence
gauucuccugccucagccuc

SEQ ID NO: 19432 - RNA, 20 nt, Artificial Sequence
  Guide Sequence
gauuguucuucaggggcaug

SEQ ID NO: 19433 - RNA, 20 nt, Artificial Sequence
  Guide Sequence
gcaaucuccgccuucugggu

SEQ ID NO: 19434 - RNA, 20 nt, Artificial Sequence
  Guide Sequence
gcagagacccccuugacuaa

SEQ ID NO: 19435 - RNA, 20 nt, Artificial Sequence
  Guide Sequence
gcaguggcgccaucucagcu

SEQ ID NO: 19436 - RNA, 20 nt, Artificial Sequence
  Guide Sequence
gcaugaggaagaggcgcuuc

SEQ ID NO: 19437 - RNA, 20 nt, Artificial Sequence
  Guide Sequence
gcauuugaaaccacaaaucg

SEQ ID NO: 19438 - RNA, 20 nt, Artificial Sequence
  Guide Sequence
gccacugugccuggccacuc

SEQ ID NO: 19439 - RNA, 20 nt, Artificial Sequence
  Guide Sequence
gccacugugccuggucuggu

SEQ ID NO: 19440 - RNA, 20 nt, Artificial Sequence
  Guide Sequence
gccaucucagcucacugcaa

SEQ ID NO: 19441 - RNA, 20 nt, Artificial Sequence
  Guide Sequence
gcccaccugugguggguagu

SEQ ID NO: 19442 - RNA, 20 nt, Artificial Sequence
  Guide Sequence
gcccaggcuggagugcagug

SEQ ID NO: 19443 - RNA, 20 nt, Artificial Sequence
  Guide Sequence
gccccagcagagacccccuu

SEQ ID NO: 19444 - RNA, 20 nt, Artificial Sequence
  Guide Sequence
gccucagccucccaaagugc

SEQ ID NO: 19445 - RNA, 20 nt, Artificial Sequence
  Guide Sequence
gccucccaaagugcugggau

SEQ ID NO: 19446 - RNA, 20 nt, Artificial Sequence
  Guide Sequence
gccucggccuuccagagugc

SEQ ID NO: 19447 - RNA, 20 nt, Artificial Sequence
  Guide Sequence
gccuggucugguuugggucu

SEQ ID NO: 19448 - RNA, 20 nt, Artificial Sequence
  Guide Sequence
gccuuccagagugcugggau

SEQ ID NO: 19449 - RNA, 20 nt, Artificial Sequence
  Guide Sequence
gccuucuggguucaaaugau

SEQ ID NO: 19450 - RNA, 20 nt, Artificial Sequence
  Guide Sequence
gcgccaucucagcucacugc

SEQ ID NO: 19451 - RNA, 20 nt, Artificial Sequence
  Guide Sequence
gcgcuuccucccuucccuug

SEQ ID NO: 19452 - RNA, 20 nt, Artificial Sequence
  Guide Sequence
gcucacugcaaucuccgccu

SEQ ID NO: 19453 - RNA, 20 nt, Artificial Sequence
  Guide Sequence
gcucugucgcccaggcugga

SEQ ID NO: 19454 - RNA, 20 nt, Artificial Sequence
  Guide Sequence
gcuggagugcaguggcgcca

SEQ ID NO: 19455 - RNA, 20 nt, Artificial Sequence
  Guide Sequence
gcugggauuaaaggugugag

SEQ ID NO: 19456 - RNA, 20 nt, Artificial Sequence
  Guide Sequence
gcugggauuacaagugugag

SEQ ID NO: 19457 - RNA, 20 nt, Artificial Sequence
  Guide Sequence
gcuguuacaaagugccccag

SEQ ID NO: 19458 - RNA, 20 nt, Artificial Sequence
  Guide Sequence
gcuuccucccuucccuuggg

SEQ ID NO: 19459 - RNA, 20 nt, Artificial Sequence
  Guide Sequence
ggaagaggcgcuuccucccu

SEQ ID NO: 19460 - RNA, 20 nt, Artificial Sequence
  Guide Sequence
ggaauacccacagugagaau

SEQ ID NO: 19461 - RNA, 20 nt, Artificial Sequence
  Guide Sequence
ggagugcaguggcgccaucu

SEQ ID NO: 19462 - RNA, 20 nt, Artificial Sequence
  Guide Sequence
ggauuaaaggugugagccac

SEQ ID NO: 19463 - RNA, 20 nt, Artificial Sequence
  Guide Sequence
ggauuacaagugugagccac

SEQ ID NO: 19464 - RNA, 20 nt, Artificial Sequence
  Guide Sequence
ggcaugaggaagaggcgcuu

SEQ ID NO: 19465 - RNA, 20 nt, Artificial Sequence
  Guide Sequence
ggccuuccagagugcuggga

SEQ ID NO: 19466 - RNA, 20 nt, Artificial Sequence
  Guide Sequence
ggcgccaucucagcucacug

SEQ ID NO: 19467 - RNA, 20 nt, Artificial Sequence
  Guide Sequence
ggcgcuuccucccuucccuu

SEQ ID NO: 19468 - RNA, 20 nt, Artificial Sequence
  Guide Sequence
ggcuggagugcaguggcgcc

SEQ ID NO: 19469 - RNA, 20 nt, Artificial Sequence
  Guide Sequence
gggaauacccacagugagaa

SEQ ID NO: 19470 - RNA, 20 nt, Artificial Sequence
  Guide Sequence
gggauuaaaggugugagcca

SEQ ID NO: 19471 - RNA, 20 nt, Artificial Sequence
  Guide Sequence
gggauuacaagugugagcca

SEQ ID NO: 19472 - RNA, 20 nt, Artificial Sequence
  Guide Sequence
gggcaugaggaagaggcgcu

SEQ ID NO: 19473 - RNA, 20 nt, Artificial Sequence
  Guide Sequence
ggggaauacccacagugaga

SEQ ID NO: 19474 - RNA, 20 nt, Artificial Sequence
  Guide Sequence
ggggcaugaggaagaggcgc

SEQ ID NO: 19475 - RNA, 20 nt, Artificial Sequence
  Guide Sequence
gggggaauacccacagugag

SEQ ID NO: 19476 - RNA, 20 nt, Artificial Sequence
  Guide Sequence
ggggugcccaccuguggugg

SEQ ID NO: 19477 - RNA, 20 nt, Artificial Sequence
  Guide Sequence
ggguaguuagguagcuguua

SEQ ID NO: 19478 - RNA, 20 nt, Artificial Sequence
  Guide Sequence
gggucucuugauuguucuuc

SEQ ID NO: 19479 - RNA, 20 nt, Artificial Sequence
  Guide Sequence
gggucucuuuuuugagucuc

SEQ ID NO: 19480 - RNA, 20 nt, Artificial Sequence
  Guide Sequence
gggugcccaccugugguggg

SEQ ID NO: 19481 - RNA, 20 nt, Artificial Sequence
  Guide Sequence
ggguucaaaugauucuccug

SEQ ID NO: 19482 - RNA, 20 nt, Artificial Sequence
  Guide Sequence
gguagcuguuacaaagugcc

SEQ ID NO: 19483 - RNA, 20 nt, Artificial Sequence
  Guide Sequence
gguaguuagguagcuguuac

SEQ ID NO: 19484 - RNA, 20 nt, Artificial Sequence
  Guide Sequence
ggucucuugauuguucuuca

SEQ ID NO: 19485 - RNA, 20 nt, Artificial Sequence
  Guide Sequence
ggucucuuuuuugagucucu

SEQ ID NO: 19486 - RNA, 20 nt, Artificial Sequence
  Guide Sequence
ggucugggucucuuuuuuga

SEQ ID NO: 19487 - RNA, 20 nt, Artificial Sequence
  Guide Sequence
ggucugguuugggucucuug

SEQ ID NO: 19488 - RNA, 20 nt, Artificial Sequence
  Guide Sequence
ggugcccaccuguggugggu

SEQ ID NO: 19489 - RNA, 20 nt, Artificial Sequence
  Guide Sequence
gguggguaguuagguagcug

SEQ ID NO: 19490 - RNA, 20 nt, Artificial Sequence
  Guide Sequence
ggugugagccacugugccug

SEQ ID NO: 19491 - RNA, 20 nt, Artificial Sequence
  Guide Sequence
gguucaaaugauucuccugc

SEQ ID NO: 19492 - RNA, 20 nt, Artificial Sequence
  Guide Sequence
gguuugggucucuugauugu

SEQ ID NO: 19493 - RNA, 20 nt, Artificial Sequence
  Guide Sequence
guagcuguuacaaagugccc

SEQ ID NO: 19494 - RNA, 20 nt, Artificial Sequence
  Guide Sequence
guaguuagguagcuguuaca

SEQ ID NO: 19495 - RNA, 20 nt, Artificial Sequence
  Guide Sequence
gucgcccaggcuggagugca

SEQ ID NO: 19496 - RNA, 20 nt, Artificial Sequence
  Guide Sequence
gucucuugauuguucuucag

SEQ ID NO: 19497 - RNA, 20 nt, Artificial Sequence
  Guide Sequence
gucucuugcucugucgccca

SEQ ID NO: 19498 - RNA, 20 nt, Artificial Sequence
  Guide Sequence
gucucuuuuuugagucucuu

SEQ ID NO: 19499 - RNA, 20 nt, Artificial Sequence
  Guide Sequence
gucugggucucuuuuuugag

SEQ ID NO: 19500 - RNA, 20 nt, Artificial Sequence
  Guide Sequence
gucugguuugggucucuuga

SEQ ID NO: 19501 - RNA, 20 nt, Artificial Sequence
  Guide Sequence
gucugugaaaugggggaaua

SEQ ID NO: 19502 - RNA, 20 nt, Artificial Sequence
  Guide Sequence
gugaaaugggggaauaccca

SEQ ID NO: 19503 - RNA, 20 nt, Artificial Sequence
  Guide Sequence
gugagaauuagaugagauag

SEQ ID NO: 19504 - RNA, 20 nt, Artificial Sequence
  Guide Sequence
gugagccacugugccuggcc

SEQ ID NO: 19505 - RNA, 20 nt, Artificial Sequence
  Guide Sequence
gugagccacugugccugguc

SEQ ID NO: 19506 - RNA, 20 nt, Artificial Sequence
  Guide Sequence
gugcaguggcgccaucucag

SEQ ID NO: 19507 - RNA, 20 nt, Artificial Sequence
  Guide Sequence
gugcccaccuguggugggua

SEQ ID NO: 19508 - RNA, 20 nt, Artificial Sequence
  Guide Sequence
gugccccagcagagaccccc

SEQ ID NO: 19509 - RNA, 20 nt, Artificial Sequence
  Guide Sequence
gugccuggucugguuugggu

SEQ ID NO: 19510 - RNA, 20 nt, Artificial Sequence
  Guide Sequence
gugcugggauuaaaggugug

SEQ ID NO: 19511 - RNA, 20 nt, Artificial Sequence
  Guide Sequence
gugcugggauuacaagugug

SEQ ID NO: 19512 - RNA, 20 nt, Artificial Sequence
  Guide Sequence
guggcgccaucucagcucac

SEQ ID NO: 19513 - RNA, 20 nt, Artificial Sequence
  Guide Sequence
guggguaguuagguagcugu

SEQ ID NO: 19514 - RNA, 20 nt, Artificial Sequence
  Guide Sequence
gugguggguaguuagguagc

SEQ ID NO: 19515 - RNA, 20 nt, Artificial Sequence
  Guide Sequence
gugugagccacugugccugg

SEQ ID NO: 19516 - RNA, 20 nt, Artificial Sequence
  Guide Sequence
guuacaaagugccccagcag

SEQ ID NO: 19517 - RNA, 20 nt, Artificial Sequence
  Guide Sequence
guuagguagcuguuacaaag

SEQ ID NO: 19518 - RNA, 20 nt, Artificial Sequence
  Guide Sequence
guucaaaugauucuccugcc

SEQ ID NO: 19519 - RNA, 20 nt, Artificial Sequence
  Guide Sequence
guucuucaggggcaugagga

SEQ ID NO: 19520 - RNA, 20 nt, Artificial Sequence
  Guide Sequence
guuuccacgucugugaaaug

SEQ ID NO: 19521 - RNA, 20 nt, Artificial Sequence
  Guide Sequence
guuugggucucuugauuguu

SEQ ID NO: 19522 - RNA, 20 nt, Artificial Sequence
  Guide Sequence
uaaaggugugagccacugug

SEQ ID NO: 19523 - RNA, 20 nt, Artificial Sequence
  Guide Sequence
uacaaagugccccagcagag

SEQ ID NO: 19524 - RNA, 20 nt, Artificial Sequence
  Guide Sequence
uacaagugugagccacugug

SEQ ID NO: 19525 - RNA, 20 nt, Artificial Sequence
  Guide Sequence
uacccacagugagaauuaga

SEQ ID NO: 19526 - RNA, 20 nt, Artificial Sequence
  Guide Sequence
uagaugagauagaugcauuu

SEQ ID NO: 19527 - RNA, 20 nt, Artificial Sequence
  Guide Sequence
uagaugcauuugaaaccaca

SEQ ID NO: 19528 - RNA, 20 nt, Artificial Sequence
  Guide Sequence
uagcuguuacaaagugcccc

SEQ ID NO: 19529 - RNA, 20 nt, Artificial Sequence
  Guide Sequence
uagguagcuguuacaaagug

SEQ ID NO: 19530 - RNA, 20 nt, Artificial Sequence
  Guide Sequence
uaguuagguagcuguuacaa

SEQ ID NO: 19531 - RNA, 20 nt, Artificial Sequence
  Guide Sequence
ucaaaugauucuccugccuc

SEQ ID NO: 19532 - RNA, 20 nt, Artificial Sequence
  Guide Sequence
ucacugcaaucuccgccuuc

SEQ ID NO: 19533 - RNA, 20 nt, Artificial Sequence
  Guide Sequence
ucagccucccaaagugcugg

SEQ ID NO: 19534 - RNA, 20 nt, Artificial Sequence
  Guide Sequence
ucagcucacugcaaucuccg

SEQ ID NO: 19535 - RNA, 20 nt, Artificial Sequence
  Guide Sequence
ucaggggcaugaggaagagg

SEQ ID NO: 19536 - RNA, 20 nt, Artificial Sequence
  Guide Sequence
ucaguuuccacgucugugaa

SEQ ID NO: 19537 - RNA, 20 nt, Artificial Sequence
  Guide Sequence
uccaccugccucggccuucc

SEQ ID NO: 19538 - RNA, 20 nt, Artificial Sequence
  Guide Sequence
uccacgucugugaaaugggg

SEQ ID NO: 19539 - RNA, 20 nt, Artificial Sequence
  Guide Sequence
uccagagugcugggauuaaa

SEQ ID NO: 19540 - RNA, 20 nt, Artificial Sequence
  Guide Sequence
ucccaaagugcugggauuac

SEQ ID NO: 19541 - RNA, 20 nt, Artificial Sequence
  Guide Sequence
ucccuucccuugggugaggg

SEQ ID NO: 19542 - RNA, 20 nt, Artificial Sequence
  Guide Sequence
ucccuugggugagggggccc

SEQ ID NO: 19543 - RNA, 20 nt, Artificial Sequence
  Guide Sequence
uccgccuucuggguucaaau

SEQ ID NO: 19544 - RNA, 20 nt, Artificial Sequence
  Guide Sequence
uccucccuucccuuggguga

SEQ ID NO: 19545 - RNA, 20 nt, Artificial Sequence
  Guide Sequence
uccugccucagccucccaaa

SEQ ID NO: 19546 - RNA, 20 nt, Artificial Sequence
  Guide Sequence
uccuggucugggucucuuuu

SEQ ID NO: 19547 - RNA, 20 nt, Artificial Sequence
  Guide Sequence
ucgcccaggcuggagugcag

SEQ ID NO: 19548 - RNA, 20 nt, Artificial Sequence
  Guide Sequence
ucggccuuccagagugcugg

SEQ ID NO: 19549 - RNA, 20 nt, Artificial Sequence
  Guide Sequence
ucggggugcccaccuguggu

SEQ ID NO: 19550 - RNA, 20 nt, Artificial Sequence
  Guide Sequence
ucucagcucacugcaaucuc

SEQ ID NO: 19551 - RNA, 20 nt, Artificial Sequence
  Guide Sequence
ucuccgccuucuggguucaa

SEQ ID NO: 19552 - RNA, 20 nt, Artificial Sequence
  Guide Sequence
ucuccugccucagccuccca

SEQ ID NO: 19553 - RNA, 20 nt, Artificial Sequence
  Guide Sequence
ucucuugauuguucuucagg

SEQ ID NO: 19554 - RNA, 20 nt, Artificial Sequence
  Guide Sequence
ucucuugcucugucgcccag

SEQ ID NO: 19555 - RNA, 20 nt, Artificial Sequence
  Guide Sequence
ucucuuuuuugagucucuug

SEQ ID NO: 19556 - RNA, 20 nt, Artificial Sequence
  Guide Sequence
ucugggucucuuuuuugagu

SEQ ID NO: 19557 - RNA, 20 nt, Artificial Sequence
  Guide Sequence
ucuggguucaaaugauucuc

SEQ ID NO: 19558 - RNA, 20 nt, Artificial Sequence
  Guide Sequence
ucugguuugggucucuugau

SEQ ID NO: 19559 - RNA, 20 nt, Artificial Sequence
  Guide Sequence
ucugucgcccaggcuggagu

SEQ ID NO: 19560 - RNA, 20 nt, Artificial Sequence
  Guide Sequence
ucugugaaaugggggaauac

SEQ ID NO: 19561 - RNA, 20 nt, Artificial Sequence
  Guide Sequence
ucuucaggggcaugaggaag

SEQ ID NO: 19562 - RNA, 20 nt, Artificial Sequence
  Guide Sequence
ucuugauuguucuucagggg

SEQ ID NO: 19563 - RNA, 20 nt, Artificial Sequence
  Guide Sequence
ucuugcucugucgcccaggc

SEQ ID NO: 19564 - RNA, 20 nt, Artificial Sequence
  Guide Sequence
ucuuuuuugagucucuugcu

SEQ ID NO: 19565 - RNA, 20 nt, Artificial Sequence
  Guide Sequence
ugaaaccacaaaucggggug

SEQ ID NO: 19566 - RNA, 20 nt, Artificial Sequence
  Guide Sequence
ugaaaugggggaauacccac

SEQ ID NO: 19567 - RNA, 20 nt, Artificial Sequence
  Guide Sequence
ugacuaacuuuuauucuucc

SEQ ID NO: 19568 - RNA, 20 nt, Artificial Sequence
  Guide Sequence
ugagaauuagaugagauaga

SEQ ID NO: 19569 - RNA, 20 nt, Artificial Sequence
  Guide Sequence
ugagauagaugcauuugaaa

SEQ ID NO: 19570 - RNA, 20 nt, Artificial Sequence
  Guide Sequence
ugagccacugugccuggcca

SEQ ID NO: 19571 - RNA, 20 nt, Artificial Sequence
  Guide Sequence
ugagccacugugccuggucu

SEQ ID NO: 19572 - RNA, 20 nt, Artificial Sequence
  Guide Sequence
ugaggaagaggcgcuuccuc

SEQ ID NO: 19573 - RNA, 20 nt, Artificial Sequence
  Guide Sequence
ugagucucuugcucugucgc

SEQ ID NO: 19574 - RNA, 20 nt, Artificial Sequence
  Guide Sequence
ugauccaccugccucggccu

SEQ ID NO: 19575 - RNA, 20 nt, Artificial Sequence
  Guide Sequence
ugauucuccugccucagccu

SEQ ID NO: 19576 - RNA, 20 nt, Artificial Sequence
  Guide Sequence
ugauuguucuucaggggcau

SEQ ID NO: 19577 - RNA, 20 nt, Artificial Sequence
  Guide Sequence
ugcaaucuccgccuucuggg

SEQ ID NO: 19578 - RNA, 20 nt, Artificial Sequence
  Guide Sequence
ugcaguggcgccaucucagc

SEQ ID NO: 19579 - RNA, 20 nt, Artificial Sequence
  Guide Sequence
ugcauuugaaaccacaaauc

SEQ ID NO: 19580 - RNA, 20 nt, Artificial Sequence
  Guide Sequence
ugcccaccugugguggguag

SEQ ID NO: 19581 - RNA, 20 nt, Artificial Sequence
  Guide Sequence
ugccccagcagagacccccu

SEQ ID NO: 19582 - RNA, 20 nt, Artificial Sequence
  Guide Sequence
ugccucagccucccaaagug

SEQ ID NO: 19583 - RNA, 20 nt, Artificial Sequence
  Guide Sequence
ugccucggccuuccagagug

SEQ ID NO: 19584 - RNA, 20 nt, Artificial Sequence
  Guide Sequence
ugccuggucugguuuggguc

SEQ ID NO: 19585 - RNA, 20 nt, Artificial Sequence
  Guide Sequence
ugcucugucgcccaggcugg

SEQ ID NO: 19586 - RNA, 20 nt, Artificial Sequence
  Guide Sequence
ugcugggauuaaagguguga

SEQ ID NO: 19587 - RNA, 20 nt, Artificial Sequence
  Guide Sequence
ugcugggauuacaaguguga

SEQ ID NO: 19588 - RNA, 20 nt, Artificial Sequence
  Guide Sequence
uggagugcaguggcgccauc

SEQ ID NO: 19589 - RNA, 20 nt, Artificial Sequence
  Guide Sequence
uggcgccaucucagcucacu

SEQ ID NO: 19590 - RNA, 20 nt, Artificial Sequence
  Guide Sequence
ugggauuaaaggugugagcc

SEQ ID NO: 19591 - RNA, 20 nt, Artificial Sequence
  Guide Sequence
ugggauuacaagugugagcc

SEQ ID NO: 19592 - RNA, 20 nt, Artificial Sequence
  Guide Sequence
ugggggaauacccacaguga

SEQ ID NO: 19593 - RNA, 20 nt, Artificial Sequence
  Guide Sequence
uggguaguuagguagcuguu

SEQ ID NO: 19594 - RNA, 20 nt, Artificial Sequence
  Guide Sequence
ugggucucuugauuguucuu

SEQ ID NO: 19595 - RNA, 20 nt, Artificial Sequence
  Guide Sequence
ugggucucuuuuuugagucu

SEQ ID NO: 19596 - RNA, 20 nt, Artificial Sequence
  Guide Sequence
uggguucaaaugauucuccu

SEQ ID NO: 19597 - RNA, 20 nt, Artificial Sequence
  Guide Sequence
uggucugggucucuuuuuug

SEQ ID NO: 19598 - RNA, 20 nt, Artificial Sequence
  Guide Sequence
uggucugguuugggucucuu

SEQ ID NO: 19599 - RNA, 20 nt, Artificial Sequence
  Guide Sequence
ugguggguaguuagguagcu

SEQ ID NO: 19600 - RNA, 20 nt, Artificial Sequence
  Guide Sequence
ugguuugggucucuugauug

SEQ ID NO: 19601 - RNA, 20 nt, Artificial Sequence
  Guide Sequence
ugucgcccaggcuggagugc

SEQ ID NO: 19602 - RNA, 20 nt, Artificial Sequence
  Guide Sequence
ugugaaaugggggaauaccc

SEQ ID NO: 19603 - RNA, 20 nt, Artificial Sequence
  Guide Sequence
ugugagccacugugccuggc

SEQ ID NO: 19604 - RNA, 20 nt, Artificial Sequence
  Guide Sequence
ugugagccacugugccuggu

SEQ ID NO: 19605 - RNA, 20 nt, Artificial Sequence
  Guide Sequence
ugugccuggccacucccuug

SEQ ID NO: 19606 - RNA, 20 nt, Artificial Sequence
  Guide Sequence
ugugccuggucugguuuggg

SEQ ID NO: 19607 - RNA, 20 nt, Artificial Sequence
  Guide Sequence
ugugguggguaguuagguag

SEQ ID NO: 19608 - RNA, 20 nt, Artificial Sequence
  Guide Sequence
uguuacaaagugccccagca

SEQ ID NO: 19609 - RNA, 20 nt, Artificial Sequence
  Guide Sequence
uguucuucaggggcaugagg

SEQ ID NO: 19610 - RNA, 20 nt, Artificial Sequence
  Guide Sequence
uuaaaggugugagccacugu

SEQ ID NO: 19611 - RNA, 20 nt, Artificial Sequence
  Guide Sequence
uuacaaagugccccagcaga

SEQ ID NO: 19612 - RNA, 20 nt, Artificial Sequence
  Guide Sequence
uuacaagugugagccacugu

SEQ ID NO: 19613 - RNA, 20 nt, Artificial Sequence
  Guide Sequence
uuagaugagauagaugcauu

SEQ ID NO: 19614 - RNA, 20 nt, Artificial Sequence
  Guide Sequence
uuagguagcuguuacaaagu

SEQ ID NO: 19615 - RNA, 20 nt, Artificial Sequence
  Guide Sequence
uucaaaugauucuccugccu

SEQ ID NO: 19616 - RNA, 20 nt, Artificial Sequence
  Guide Sequence
uucaggggcaugaggaagag

SEQ ID NO: 19617 - RNA, 20 nt, Artificial Sequence
  Guide Sequence
uuccacgucugugaaauggg

SEQ ID NO: 19618 - RNA, 20 nt, Artificial Sequence
  Guide Sequence
uuccagagugcugggauuaa

SEQ ID NO: 19619 - RNA, 20 nt, Artificial Sequence
  Guide Sequence
uucccuugggugagggggcc

SEQ ID NO: 19620 - RNA, 20 nt, Artificial Sequence
  Guide Sequence
uuccucccuucccuugggug

SEQ ID NO: 19621 - RNA, 20 nt, Artificial Sequence
  Guide Sequence
uucuccugccucagccuccc

SEQ ID NO: 19622 - RNA, 20 nt, Artificial Sequence
  Guide Sequence
uucuggguucaaaugauucu

SEQ ID NO: 19623 - RNA, 20 nt, Artificial Sequence
  Guide Sequence
uucuucaggggcaugaggaa

SEQ ID NO: 19624 - RNA, 20 nt, Artificial Sequence
  Guide Sequence
uugaaaccacaaaucggggu

SEQ ID NO: 19625 - RNA, 20 nt, Artificial Sequence
  Guide Sequence
uugagucucuugcucugucg

SEQ ID NO: 19626 - RNA, 20 nt, Artificial Sequence
  Guide Sequence
uugauuguucuucaggggca

SEQ ID NO: 19627 - RNA, 20 nt, Artificial Sequence
  Guide Sequence
uugcucugucgcccaggcug

SEQ ID NO: 19628 - RNA, 20 nt, Artificial Sequence
  Guide Sequence
uugggucucuugauuguucu

SEQ ID NO: 19629 - RNA, 20 nt, Artificial Sequence
  Guide Sequence
uugggugagggggcccaggg

SEQ ID NO: 19630 - RNA, 20 nt, Artificial Sequence
  Guide Sequence
uuguucuucaggggcaugag

SEQ ID NO: 19631 - RNA, 20 nt, Artificial Sequence
  Guide Sequence
uuuauucuuccaucuuuucc

SEQ ID NO: 19632 - RNA, 20 nt, Artificial Sequence
  Guide Sequence
uuuccacgucugugaaaugg

SEQ ID NO: 19633 - RNA, 20 nt, Artificial Sequence
  Guide Sequence
uuugaaaccacaaaucgggg

SEQ ID NO: 19634 - RNA, 20 nt, Artificial Sequence
  Guide Sequence
uuugagucucuugcucuguc

SEQ ID NO: 19635 - RNA, 20 nt, Artificial Sequence
  Guide Sequence
uuugggucucuugauuguuc

SEQ ID NO: 19636 - RNA, 20 nt, Artificial Sequence
  Guide Sequence
uuuugagucucuugcucugu

SEQ ID NO: 19637 - RNA, 20 nt, Artificial Sequence
  Guide Sequence
uuuuugagucucuugcucug

SEQ ID NO: 19638 - RNA, 20 nt, Artificial Sequence
  Guide Sequence
uuuuuugagucucuugcucu

SEQ ID NO: 19639 - RNA, 21 nt, Artificial Sequence
  Guide Sequence
aaaccacaaaucggggugccc

SEQ ID NO: 19640 - RNA, 21 nt, Artificial Sequence
  Guide Sequence
aaaggugugagccacugugcc

SEQ ID NO: 19641 - RNA, 21 nt, Artificial Sequence
  Guide Sequence
aaagugccccagcagagaccc

SEQ ID NO: 19642 - RNA, 21 nt, Artificial Sequence
  Guide Sequence
aaagugcugggauuacaagug

SEQ ID NO: 19643 - RNA, 21 nt, Artificial Sequence
  Guide Sequence
aaaucggggugcccaccugug

SEQ ID NO: 19644 - RNA, 21 nt, Artificial Sequence
  Guide Sequence
aaaugauucuccugccucagc

SEQ ID NO: 19645 - RNA, 21 nt, Artificial Sequence
  Guide Sequence
aaaugggggaauacccacagu

SEQ ID NO: 19646 - RNA, 21 nt, Artificial Sequence
  Guide Sequence
aaccacaaaucggggugccca

SEQ ID NO: 19647 - RNA, 21 nt, Artificial Sequence
  Guide Sequence
aagaggcgcuuccucccuucc

SEQ ID NO: 19648 - RNA, 21 nt, Artificial Sequence
  Guide Sequence
aaggugugagccacugugccu

SEQ ID NO: 19649 - RNA, 21 nt, Artificial Sequence
  Guide Sequence
aagugccccagcagagacccc

SEQ ID NO: 19650 - RNA, 21 nt, Artificial Sequence
  Guide Sequence
aagugcugggauuacaagugu

SEQ ID NO: 19651 - RNA, 21 nt, Artificial Sequence
  Guide Sequence
aagugugagccacugugccug

SEQ ID NO: 19652 - RNA, 21 nt, Artificial Sequence
  Guide Sequence
aauacccacagugagaauuag

SEQ ID NO: 19653 - RNA, 21 nt, Artificial Sequence
  Guide Sequence
aaucggggugcccaccugugg

SEQ ID NO: 19654 - RNA, 21 nt, Artificial Sequence
  Guide Sequence
aaucuccgccuucuggguuca

SEQ ID NO: 19655 - RNA, 21 nt, Artificial Sequence
  Guide Sequence
aaugauucuccugccucagcc

SEQ ID NO: 19656 - RNA, 21 nt, Artificial Sequence
  Guide Sequence
aaugggggaauacccacagug

SEQ ID NO: 19657 - RNA, 21 nt, Artificial Sequence
  Guide Sequence
acaaagugccccagcagagac

SEQ ID NO: 19658 - RNA, 21 nt, Artificial Sequence
  Guide Sequence
acaaaucggggugcccaccug

SEQ ID NO: 19659 - RNA, 21 nt, Artificial Sequence
  Guide Sequence
acaagugugagccacugugcc

SEQ ID NO: 19660 - RNA, 21 nt, Artificial Sequence
  Guide Sequence
acagugagaauuagaugagau

SEQ ID NO: 19661 - RNA, 21 nt, Artificial Sequence
  Guide Sequence
accacaaaucggggugcccac

SEQ ID NO: 19662 - RNA, 21 nt, Artificial Sequence
  Guide Sequence
acccacagugagaauuagaug

SEQ ID NO: 19663 - RNA, 21 nt, Artificial Sequence
  Guide Sequence
acccccuugacuaacuuuuau

SEQ ID NO: 19664 - RNA, 21 nt, Artificial Sequence
  Guide Sequence
accugccucggccuuccagag

SEQ ID NO: 19665 - RNA, 21 nt, Artificial Sequence
  Guide Sequence
accugugguggguaguuaggu

SEQ ID NO: 19666 - RNA, 21 nt, Artificial Sequence
  Guide Sequence
acgucugugaaaugggggaau

SEQ ID NO: 19667 - RNA, 21 nt, Artificial Sequence
  Guide Sequence
acugcaaucuccgccuucugg

SEQ ID NO: 19668 - RNA, 21 nt, Artificial Sequence
  Guide Sequence
acugugccuggccacucccuu

SEQ ID NO: 19669 - RNA, 21 nt, Artificial Sequence
  Guide Sequence
acugugccuggucugguuugg

SEQ ID NO: 19670 - RNA, 21 nt, Artificial Sequence
  Guide Sequence
agaauuagaugagauagaugc

SEQ ID NO: 19671 - RNA, 21 nt, Artificial Sequence
  Guide Sequence
agacccccuugacuaacuuuu

SEQ ID NO: 19672 - RNA, 21 nt, Artificial Sequence
  Guide Sequence
agagacccccuugacuaacuu

SEQ ID NO: 19673 - RNA, 21 nt, Artificial Sequence
  Guide Sequence
agaggcgcuuccucccuuccc

SEQ ID NO: 19674 - RNA, 21 nt, Artificial Sequence
  Guide Sequence
agagugcugggauuaaaggug

SEQ ID NO: 19675 - RNA, 21 nt, Artificial Sequence
  Guide Sequence
agauagaugcauuugaaacca

SEQ ID NO: 19676 - RNA, 21 nt, Artificial Sequence
  Guide Sequence
agaugagauagaugcauuuga

SEQ ID NO: 19677 - RNA, 21 nt, Artificial Sequence
  Guide Sequence
agaugcauuugaaaccacaaa

SEQ ID NO: 19678 - RNA, 21 nt, Artificial Sequence
  Guide Sequence
agcagagacccccuugacuaa

SEQ ID NO: 19679 - RNA, 21 nt, Artificial Sequence
  Guide Sequence
agccacugugccuggccacuc

SEQ ID NO: 19680 - RNA, 21 nt, Artificial Sequence
  Guide Sequence
agccacugugccuggucuggu

SEQ ID NO: 19681 - RNA, 21 nt, Artificial Sequence
  Guide Sequence
agccucccaaagugcugggau

SEQ ID NO: 19682 - RNA, 21 nt, Artificial Sequence
  Guide Sequence
agcucacugcaaucuccgccu

SEQ ID NO: 19683 - RNA, 21 nt, Artificial Sequence
  Guide Sequence
agcuguuacaaagugccccag

SEQ ID NO: 19684 - RNA, 21 nt, Artificial Sequence
  Guide Sequence
aggaagaggcgcuuccucccu

SEQ ID NO: 19685 - RNA, 21 nt, Artificial Sequence
  Guide Sequence
aggcgcuuccucccuucccuu

SEQ ID NO: 19686 - RNA, 21 nt, Artificial Sequence
  Guide Sequence
aggcuggagugcaguggcgcc

SEQ ID NO: 19687 - RNA, 21 nt, Artificial Sequence
  Guide Sequence
aggggcaugaggaagaggcgc

SEQ ID NO: 19688 - RNA, 21 nt, Artificial Sequence
  Guide Sequence
agguagcuguuacaaagugcc

SEQ ID NO: 19689 - RNA, 21 nt, Artificial Sequence
  Guide Sequence
aggugugagccacugugccug

SEQ ID NO: 19690 - RNA, 21 nt, Artificial Sequence
  Guide Sequence
agucucuugcucugucgccca

SEQ ID NO: 19691 - RNA, 21 nt, Artificial Sequence
  Guide Sequence
agugagaauuagaugagauag

SEQ ID NO: 19692 - RNA, 21 nt, Artificial Sequence
  Guide Sequence
agugcaguggcgccaucucag

SEQ ID NO: 19693 - RNA, 21 nt, Artificial Sequence
  Guide Sequence
agugccccagcagagaccccc

SEQ ID NO: 19694 - RNA, 21 nt, Artificial Sequence
  Guide Sequence
agugcugggauuaaaggugug

SEQ ID NO: 19695 - RNA, 21 nt, Artificial Sequence
  Guide Sequence
agugcugggauuacaagugug

SEQ ID NO: 19696 - RNA, 21 nt, Artificial Sequence
  Guide Sequence
aguggcgccaucucagcucac

SEQ ID NO: 19697 - RNA, 21 nt, Artificial Sequence
  Guide Sequence
agugugagccacugugccugg

SEQ ID NO: 19698 - RNA, 21 nt, Artificial Sequence
  Guide Sequence
aguuagguagcuguuacaaag

SEQ ID NO: 19699 - RNA, 21 nt, Artificial Sequence
  Guide Sequence
aguuuccacgucugugaaaug

SEQ ID NO: 19700 - RNA, 21 nt, Artificial Sequence
  Guide Sequence
auacccacagugagaauuaga

SEQ ID NO: 19701 - RNA, 21 nt, Artificial Sequence
  Guide Sequence
auagaugcauuugaaaccaca

SEQ ID NO: 19702 - RNA, 21 nt, Artificial Sequence
  Guide Sequence
auccaccugccucggccuucc

SEQ ID NO: 19703 - RNA, 21 nt, Artificial Sequence
  Guide Sequence
auccuggucugggucucuuuu

SEQ ID NO: 19704 - RNA, 21 nt, Artificial Sequence
  Guide Sequence
aucggggugcccaccuguggu

SEQ ID NO: 19705 - RNA, 21 nt, Artificial Sequence
  Guide Sequence
aucucagcucacugcaaucuc

SEQ ID NO: 19706 - RNA, 21 nt, Artificial Sequence
  Guide Sequence
aucuccgccuucuggguucaa

SEQ ID NO: 19707 - RNA, 21 nt, Artificial Sequence
  Guide Sequence
augaggaagaggcgcuuccuc

SEQ ID NO: 19708 - RNA, 21 nt, Artificial Sequence
  Guide Sequence
augauucuccugccucagccu

SEQ ID NO: 19709 - RNA, 21 nt, Artificial Sequence
  Guide Sequence
augcauuugaaaccacaaauc

SEQ ID NO: 19710 - RNA, 21 nt, Artificial Sequence
  Guide Sequence
augggggaauacccacaguga

SEQ ID NO: 19711 - RNA, 21 nt, Artificial Sequence
  Guide Sequence
auuaaaggugugagccacugu

SEQ ID NO: 19712 - RNA, 21 nt, Artificial Sequence
  Guide Sequence
auuacaagugugagccacugu

SEQ ID NO: 19713 - RNA, 21 nt, Artificial Sequence
  Guide Sequence
auucuccugccucagccuccc

SEQ ID NO: 19714 - RNA, 21 nt, Artificial Sequence
  Guide Sequence
auuguucuucaggggcaugag

SEQ ID NO: 19715 - RNA, 21 nt, Artificial Sequence
  Guide Sequence
auuugaaaccacaaaucgggg

SEQ ID NO: 19716 - RNA, 21 nt, Artificial Sequence
  Guide Sequence
caaagugccccagcagagacc

SEQ ID NO: 19717 - RNA, 21 nt, Artificial Sequence
  Guide Sequence
caaagugcugggauuacaagu

SEQ ID NO: 19718 - RNA, 21 nt, Artificial Sequence
  Guide Sequence
caaaucggggugcccaccugu

SEQ ID NO: 19719 - RNA, 21 nt, Artificial Sequence
  Guide Sequence
caaaugauucuccugccucag

SEQ ID NO: 19720 - RNA, 21 nt, Artificial Sequence
  Guide Sequence
caagugugagccacugugccu

SEQ ID NO: 19721 - RNA, 21 nt, Artificial Sequence
  Guide Sequence
caaucuccgccuucuggguuc

SEQ ID NO: 19722 - RNA, 21 nt, Artificial Sequence
  Guide Sequence
cacaaaucggggugcccaccu

SEQ ID NO: 19723 - RNA, 21 nt, Artificial Sequence
  Guide Sequence
cacagugagaauuagaugaga

SEQ ID NO: 19724 - RNA, 21 nt, Artificial Sequence
  Guide Sequence
caccugccucggccuuccaga

SEQ ID NO: 19725 - RNA, 21 nt, Artificial Sequence
  Guide Sequence
caccugugguggguaguuagg

SEQ ID NO: 19726 - RNA, 21 nt, Artificial Sequence
  Guide Sequence
cacgucugugaaaugggggaa

SEQ ID NO: 19727 - RNA, 21 nt, Artificial Sequence
  Guide Sequence
cacugcaaucuccgccuucug

SEQ ID NO: 19728 - RNA, 21 nt, Artificial Sequence
  Guide Sequence
cacugugccuggccacucccu

SEQ ID NO: 19729 - RNA, 21 nt, Artificial Sequence
  Guide Sequence
cacugugccuggucugguuug

SEQ ID NO: 19730 - RNA, 21 nt, Artificial Sequence
  Guide Sequence
cagagacccccuugacuaacu

SEQ ID NO: 19731 - RNA, 21 nt, Artificial Sequence
  Guide Sequence
cagagugcugggauuaaaggu

SEQ ID NO: 19732 - RNA, 21 nt, Artificial Sequence
  Guide Sequence
cagcagagacccccuugacua

SEQ ID NO: 19733 - RNA, 21 nt, Artificial Sequence
  Guide Sequence
cagccucccaaagugcuggga

SEQ ID NO: 19734 - RNA, 21 nt, Artificial Sequence
  Guide Sequence
cagcucacugcaaucuccgcc

SEQ ID NO: 19735 - RNA, 21 nt, Artificial Sequence
  Guide Sequence
caggcuggagugcaguggcgc

SEQ ID NO: 19736 - RNA, 21 nt, Artificial Sequence
  Guide Sequence
caggggcaugaggaagaggcg

SEQ ID NO: 19737 - RNA, 21 nt, Artificial Sequence
  Guide Sequence
cagugagaauuagaugagaua

SEQ ID NO: 19738 - RNA, 21 nt, Artificial Sequence
  Guide Sequence
caguggcgccaucucagcuca

SEQ ID NO: 19739 - RNA, 21 nt, Artificial Sequence
  Guide Sequence
caguuuccacgucugugaaau

SEQ ID NO: 19740 - RNA, 21 nt, Artificial Sequence
  Guide Sequence
caucucagcucacugcaaucu

SEQ ID NO: 19741 - RNA, 21 nt, Artificial Sequence
  Guide Sequence
caugaggaagaggcgcuuccu

SEQ ID NO: 19742 - RNA, 21 nt, Artificial Sequence
  Guide Sequence
cauuugaaaccacaaaucggg

SEQ ID NO: 19743 - RNA, 21 nt, Artificial Sequence
  Guide Sequence
ccaaagugcugggauuacaag

SEQ ID NO: 19744 - RNA, 21 nt, Artificial Sequence
  Guide Sequence
ccacaaaucggggugcccacc

SEQ ID NO: 19745 - RNA, 21 nt, Artificial Sequence
  Guide Sequence
ccacagugagaauuagaugag

SEQ ID NO: 19746 - RNA, 21 nt, Artificial Sequence
  Guide Sequence
ccaccugccucggccuuccag

SEQ ID NO: 19747 - RNA, 21 nt, Artificial Sequence
  Guide Sequence
ccaccugugguggguaguuag

SEQ ID NO: 19748 - RNA, 21 nt, Artificial Sequence
  Guide Sequence
ccacgucugugaaauggggga

SEQ ID NO: 19749 - RNA, 21 nt, Artificial Sequence
  Guide Sequence
ccacugugccuggccacuccc

SEQ ID NO: 19750 - RNA, 21 nt, Artificial Sequence
  Guide Sequence
ccacugugccuggucugguuu

SEQ ID NO: 19751 - RNA, 21 nt, Artificial Sequence
  Guide Sequence
ccagagugcugggauuaaagg

SEQ ID NO: 19752 - RNA, 21 nt, Artificial Sequence
  Guide Sequence
ccagcagagacccccuugacu

SEQ ID NO: 19753 - RNA, 21 nt, Artificial Sequence
  Guide Sequence
ccaggcuggagugcaguggcg

SEQ ID NO: 19754 - RNA, 21 nt, Artificial Sequence
  Guide Sequence
ccaucucagcucacugcaauc

SEQ ID NO: 19755 - RNA, 21 nt, Artificial Sequence
  Guide Sequence
cccaaagugcugggauuacaa

SEQ ID NO: 19756 - RNA, 21 nt, Artificial Sequence
  Guide Sequence
cccacagugagaauuagauga

SEQ ID NO: 19757 - RNA, 21 nt, Artificial Sequence
  Guide Sequence
cccaccugugguggguaguua

SEQ ID NO: 19758 - RNA, 21 nt, Artificial Sequence
  Guide Sequence
cccagcagagacccccuugac

SEQ ID NO: 19759 - RNA, 21 nt, Artificial Sequence
  Guide Sequence
cccaggcuggagugcaguggc

SEQ ID NO: 19760 - RNA, 21 nt, Artificial Sequence
  Guide Sequence
ccccagcagagacccccuuga

SEQ ID NO: 19761 - RNA, 21 nt, Artificial Sequence
  Guide Sequence
cccccuugacuaacuuuuauu

SEQ ID NO: 19762 - RNA, 21 nt, Artificial Sequence
  Guide Sequence
ccccuugacuaacuuuuauuc

SEQ ID NO: 19763 - RNA, 21 nt, Artificial Sequence
  Guide Sequence
cccuucccuugggugaggggg

SEQ ID NO: 19764 - RNA, 21 nt, Artificial Sequence
  Guide Sequence
cccuugacuaacuuuuauucu

SEQ ID NO: 19765 - RNA, 21 nt, Artificial Sequence
  Guide Sequence
cccuugggugagggggcccag

SEQ ID NO: 19766 - RNA, 21 nt, Artificial Sequence
  Guide Sequence
ccgccuucuggguucaaauga

SEQ ID NO: 19767 - RNA, 21 nt, Artificial Sequence
  Guide Sequence
ccucagccucccaaagugcug

SEQ ID NO: 19768 - RNA, 21 nt, Artificial Sequence
  Guide Sequence
ccucccaaagugcugggauua

SEQ ID NO: 19769 - RNA, 21 nt, Artificial Sequence
  Guide Sequence
ccucccuucccuugggugagg

SEQ ID NO: 19770 - RNA, 21 nt, Artificial Sequence
  Guide Sequence
ccucggccuuccagagugcug

SEQ ID NO: 19771 - RNA, 21 nt, Artificial Sequence
  Guide Sequence
ccugccucagccucccaaagu

SEQ ID NO: 19772 - RNA, 21 nt, Artificial Sequence
  Guide Sequence
ccugccucggccuuccagagu

SEQ ID NO: 19773 - RNA, 21 nt, Artificial Sequence
  Guide Sequence
ccuggucugggucucuuuuuu

SEQ ID NO: 19774 - RNA, 21 nt, Artificial Sequence
  Guide Sequence
ccuggucugguuugggucucu

SEQ ID NO: 19775 - RNA, 21 nt, Artificial Sequence
  Guide Sequence
ccugugguggguaguuaggua

SEQ ID NO: 19776 - RNA, 21 nt, Artificial Sequence
  Guide Sequence
ccuuccagagugcugggauua

SEQ ID NO: 19777 - RNA, 21 nt, Artificial Sequence
  Guide Sequence
ccuucccuugggugagggggc

SEQ ID NO: 19778 - RNA, 21 nt, Artificial Sequence
  Guide Sequence
ccuucuggguucaaaugauuc

SEQ ID NO: 19779 - RNA, 21 nt, Artificial Sequence
  Guide Sequence
ccuugggugagggggcccagg

SEQ ID NO: 19780 - RNA, 21 nt, Artificial Sequence
  Guide Sequence
cgccaucucagcucacugcaa

SEQ ID NO: 19781 - RNA, 21 nt, Artificial Sequence
  Guide Sequence
cgcccaggcuggagugcagug

SEQ ID NO: 19782 - RNA, 21 nt, Artificial Sequence
  Guide Sequence
cgccuucuggguucaaaugau

SEQ ID NO: 19783 - RNA, 21 nt, Artificial Sequence
  Guide Sequence
cgcuuccucccuucccuuggg

SEQ ID NO: 19784 - RNA, 21 nt, Artificial Sequence
  Guide Sequence
cggccuuccagagugcuggga

SEQ ID NO: 19785 - RNA, 21 nt, Artificial Sequence
  Guide Sequence
cggggugcccaccuguggugg

SEQ ID NO: 19786 - RNA, 21 nt, Artificial Sequence
  Guide Sequence
cgucugugaaaugggggaaua

SEQ ID NO: 19787 - RNA, 21 nt, Artificial Sequence
  Guide Sequence
cucacugcaaucuccgccuuc

SEQ ID NO: 19788 - RNA, 21 nt, Artificial Sequence
  Guide Sequence
cucagccucccaaagugcugg

SEQ ID NO: 19789 - RNA, 21 nt, Artificial Sequence
  Guide Sequence
cucagcucacugcaaucuccg

SEQ ID NO: 19790 - RNA, 21 nt, Artificial Sequence
  Guide Sequence
cucccaaagugcugggauuac

SEQ ID NO: 19791 - RNA, 21 nt, Artificial Sequence
  Guide Sequence
cucccuucccuugggugaggg

SEQ ID NO: 19792 - RNA, 21 nt, Artificial Sequence
  Guide Sequence
cuccgccuucuggguucaaau

SEQ ID NO: 19793 - RNA, 21 nt, Artificial Sequence
  Guide Sequence
cuccugccucagccucccaaa

SEQ ID NO: 19794 - RNA, 21 nt, Artificial Sequence
  Guide Sequence
cucggccuuccagagugcugg

SEQ ID NO: 19795 - RNA, 21 nt, Artificial Sequence
  Guide Sequence
cucugucgcccaggcuggagu

SEQ ID NO: 19796 - RNA, 21 nt, Artificial Sequence
  Guide Sequence
cucuugauuguucuucagggg

SEQ ID NO: 19797 - RNA, 21 nt, Artificial Sequence
  Guide Sequence
cucuugcucugucgcccaggc

SEQ ID NO: 19798 - RNA, 21 nt, Artificial Sequence
  Guide Sequence
cucuuuuuugagucucuugcu

SEQ ID NO: 19799 - RNA, 21 nt, Artificial Sequence
  Guide Sequence
cugcaaucuccgccuucuggg

SEQ ID NO: 19800 - RNA, 21 nt, Artificial Sequence
  Guide Sequence
cugccucagccucccaaagug

SEQ ID NO: 19801 - RNA, 21 nt, Artificial Sequence
  Guide Sequence
cugccucggccuuccagagug

SEQ ID NO: 19802 - RNA, 21 nt, Artificial Sequence
  Guide Sequence
cuggagugcaguggcgccauc

SEQ ID NO: 19803 - RNA, 21 nt, Artificial Sequence
  Guide Sequence
cugggauuaaaggugugagcc

SEQ ID NO: 19804 - RNA, 21 nt, Artificial Sequence
  Guide Sequence
cugggauuacaagugugagcc

SEQ ID NO: 19805 - RNA, 21 nt, Artificial Sequence
  Guide Sequence
cugggucucuuuuuugagucu

SEQ ID NO: 19806 - RNA, 21 nt, Artificial Sequence
  Guide Sequence
cuggguucaaaugauucuccu

SEQ ID NO: 19807 - RNA, 21 nt, Artificial Sequence
  Guide Sequence
cuggucugggucucuuuuuug

SEQ ID NO: 19808 - RNA, 21 nt, Artificial Sequence
  Guide Sequence
cuggucugguuugggucucuu

SEQ ID NO: 19809 - RNA, 21 nt, Artificial Sequence
  Guide Sequence
cugguuugggucucuugauug

SEQ ID NO: 19810 - RNA, 21 nt, Artificial Sequence
  Guide Sequence
cugucgcccaggcuggagugc

SEQ ID NO: 19811 - RNA, 21 nt, Artificial Sequence
  Guide Sequence
cugugaaaugggggaauaccc

SEQ ID NO: 19812 - RNA, 21 nt, Artificial Sequence
  Guide Sequence
cugugccuggccacucccuug

SEQ ID NO: 19813 - RNA, 21 nt, Artificial Sequence
  Guide Sequence
cugugccuggucugguuuggg

SEQ ID NO: 19814 - RNA, 21 nt, Artificial Sequence
  Guide Sequence
cugugguggguaguuagguag

SEQ ID NO: 19815 - RNA, 21 nt, Artificial Sequence
  Guide Sequence
cuguuacaaagugccccagca

SEQ ID NO: 19816 - RNA, 21 nt, Artificial Sequence
  Guide Sequence
cuucaggggcaugaggaagag

SEQ ID NO: 19817 - RNA, 21 nt, Artificial Sequence
  Guide Sequence
cuuccagagugcugggauuaa

SEQ ID NO: 19818 - RNA, 21 nt, Artificial Sequence
  Guide Sequence
cuucccuugggugagggggcc

SEQ ID NO: 19819 - RNA, 21 nt, Artificial Sequence
  Guide Sequence
cuuccucccuucccuugggug

SEQ ID NO: 19820 - RNA, 21 nt, Artificial Sequence
  Guide Sequence
cuucuggguucaaaugauucu

SEQ ID NO: 19821 - RNA, 21 nt, Artificial Sequence
  Guide Sequence
cuugauuguucuucaggggca

SEQ ID NO: 19822 - RNA, 21 nt, Artificial Sequence
  Guide Sequence
cuugcucugucgcccaggcug

SEQ ID NO: 19823 - RNA, 21 nt, Artificial Sequence
  Guide Sequence
cuugggugagggggcccaggg

SEQ ID NO: 19824 - RNA, 21 nt, Artificial Sequence
  Guide Sequence
cuuuuuugagucucuugcucu

SEQ ID NO: 19825 - RNA, 21 nt, Artificial Sequence
  Guide Sequence
gaaaccacaaaucggggugcc

SEQ ID NO: 19826 - RNA, 21 nt, Artificial Sequence
  Guide Sequence
gaaaugggggaauacccacag

SEQ ID NO: 19827 - RNA, 21 nt, Artificial Sequence
  Guide Sequence
gaagaggcgcuuccucccuuc

SEQ ID NO: 19828 - RNA, 21 nt, Artificial Sequence
  Guide Sequence
gaauacccacagugagaauua

SEQ ID NO: 19829 - RNA, 21 nt, Artificial Sequence
  Guide Sequence
gaauuagaugagauagaugca

SEQ ID NO: 19830 - RNA, 21 nt, Artificial Sequence
  Guide Sequence
gacccccuugacuaacuuuua

SEQ ID NO: 19831 - RNA, 21 nt, Artificial Sequence
  Guide Sequence
gagaauuagaugagauagaug

SEQ ID NO: 19832 - RNA, 21 nt, Artificial Sequence
  Guide Sequence
gagacccccuugacuaacuuu

SEQ ID NO: 19833 - RNA, 21 nt, Artificial Sequence
  Guide Sequence
gagauagaugcauuugaaacc

SEQ ID NO: 19834 - RNA, 21 nt, Artificial Sequence
  Guide Sequence
gagccacugugccuggccacu

SEQ ID NO: 19835 - RNA, 21 nt, Artificial Sequence
  Guide Sequence
gagccacugugccuggucugg

SEQ ID NO: 19836 - RNA, 21 nt, Artificial Sequence
  Guide Sequence
gaggaagaggcgcuuccuccc

SEQ ID NO: 19837 - RNA, 21 nt, Artificial Sequence
  Guide Sequence
gaggcgcuuccucccuucccu

SEQ ID NO: 19838 - RNA, 21 nt, Artificial Sequence
  Guide Sequence
gagucucuugcucugucgccc

SEQ ID NO: 19839 - RNA, 21 nt, Artificial Sequence
  Guide Sequence
gagugcaguggcgccaucuca

SEQ ID NO: 19840 - RNA, 21 nt, Artificial Sequence
  Guide Sequence
gagugcugggauuaaaggugu

SEQ ID NO: 19841 - RNA, 21 nt, Artificial Sequence
  Guide Sequence
gauagaugcauuugaaaccac

SEQ ID NO: 19842 - RNA, 21 nt, Artificial Sequence
  Guide Sequence
gauccaccugccucggccuuc

SEQ ID NO: 19843 - RNA, 21 nt, Artificial Sequence
  Guide Sequence
gaugagauagaugcauuugaa

SEQ ID NO: 19844 - RNA, 21 nt, Artificial Sequence
  Guide Sequence
gaugcauuugaaaccacaaau

SEQ ID NO: 19845 - RNA, 21 nt, Artificial Sequence
  Guide Sequence
gauuaaaggugugagccacug

SEQ ID NO: 19846 - RNA, 21 nt, Artificial Sequence
  Guide Sequence
gauuacaagugugagccacug

SEQ ID NO: 19847 - RNA, 21 nt, Artificial Sequence
  Guide Sequence
gauucuccugccucagccucc

SEQ ID NO: 19848 - RNA, 21 nt, Artificial Sequence
  Guide Sequence
gauuguucuucaggggcauga

SEQ ID NO: 19849 - RNA, 21 nt, Artificial Sequence
  Guide Sequence
gcaaucuccgccuucuggguu

SEQ ID NO: 19850 - RNA, 21 nt, Artificial Sequence
  Guide Sequence
gcagagacccccuugacuaac

SEQ ID NO: 19851 - RNA, 21 nt, Artificial Sequence
  Guide Sequence
gcaguggcgccaucucagcuc

SEQ ID NO: 19852 - RNA, 21 nt, Artificial Sequence
  Guide Sequence
gcaugaggaagaggcgcuucc

SEQ ID NO: 19853 - RNA, 21 nt, Artificial Sequence
  Guide Sequence
gcauuugaaaccacaaaucgg

SEQ ID NO: 19854 - RNA, 21 nt, Artificial Sequence
  Guide Sequence
gccacugugccuggccacucc

SEQ ID NO: 19855 - RNA, 21 nt, Artificial Sequence
  Guide Sequence
gccacugugccuggucugguu

SEQ ID NO: 19856 - RNA, 21 nt, Artificial Sequence
  Guide Sequence
gccaucucagcucacugcaau

SEQ ID NO: 19857 - RNA, 21 nt, Artificial Sequence
  Guide Sequence
gcccaccugugguggguaguu

SEQ ID NO: 19858 - RNA, 21 nt, Artificial Sequence
  Guide Sequence
gcccaggcuggagugcagugg

SEQ ID NO: 19859 - RNA, 21 nt, Artificial Sequence
  Guide Sequence
gccccagcagagacccccuug

SEQ ID NO: 19860 - RNA, 21 nt, Artificial Sequence
  Guide Sequence
gccucagccucccaaagugcu

SEQ ID NO: 19861 - RNA, 21 nt, Artificial Sequence
  Guide Sequence
gccucccaaagugcugggauu

SEQ ID NO: 19862 - RNA, 21 nt, Artificial Sequence
  Guide Sequence
gccucggccuuccagagugcu

SEQ ID NO: 19863 - RNA, 21 nt, Artificial Sequence
  Guide Sequence
gccuggucugguuugggucuc

SEQ ID NO: 19864 - RNA, 21 nt, Artificial Sequence
  Guide Sequence
gccuuccagagugcugggauu

SEQ ID NO: 19865 - RNA, 21 nt, Artificial Sequence
  Guide Sequence
gccuucuggguucaaaugauu

SEQ ID NO: 19866 - RNA, 21 nt, Artificial Sequence
  Guide Sequence
gcgccaucucagcucacugca

SEQ ID NO: 19867 - RNA, 21 nt, Artificial Sequence
  Guide Sequence
gcgcuuccucccuucccuugg

SEQ ID NO: 19868 - RNA, 21 nt, Artificial Sequence
  Guide Sequence
gcucacugcaaucuccgccuu

SEQ ID NO: 19869 - RNA, 21 nt, Artificial Sequence
  Guide Sequence
gcucugucgcccaggcuggag

SEQ ID NO: 19870 - RNA, 21 nt, Artificial Sequence
  Guide Sequence
gcuggagugcaguggcgccau

SEQ ID NO: 19871 - RNA, 21 nt, Artificial Sequence
  Guide Sequence
gcugggauuaaaggugugagc

SEQ ID NO: 19872 - RNA, 21 nt, Artificial Sequence
  Guide Sequence
gcugggauuacaagugugagc

SEQ ID NO: 19873 - RNA, 21 nt, Artificial Sequence
  Guide Sequence
gcuguuacaaagugccccagc

SEQ ID NO: 19874 - RNA, 21 nt, Artificial Sequence
  Guide Sequence
gcuuccucccuucccuugggu

SEQ ID NO: 19875 - RNA, 21 nt, Artificial Sequence
  Guide Sequence
ggaagaggcgcuuccucccuu

SEQ ID NO: 19876 - RNA, 21 nt, Artificial Sequence
  Guide Sequence
ggaauacccacagugagaauu

SEQ ID NO: 19877 - RNA, 21 nt, Artificial Sequence
  Guide Sequence
ggagugcaguggcgccaucuc

SEQ ID NO: 19878 - RNA, 21 nt, Artificial Sequence
  Guide Sequence
ggauuaaaggugugagccacu

SEQ ID NO: 19879 - RNA, 21 nt, Artificial Sequence
  Guide Sequence
ggauuacaagugugagccacu

SEQ ID NO: 19880 - RNA, 21 nt, Artificial Sequence
  Guide Sequence
ggcaugaggaagaggcgcuuc

SEQ ID NO: 19881 - RNA, 21 nt, Artificial Sequence
  Guide Sequence
ggccuuccagagugcugggau

SEQ ID NO: 19882 - RNA, 21 nt, Artificial Sequence
  Guide Sequence
ggcgccaucucagcucacugc

SEQ ID NO: 19883 - RNA, 21 nt, Artificial Sequence
  Guide Sequence
ggcgcuuccucccuucccuug

SEQ ID NO: 19884 - RNA, 21 nt, Artificial Sequence
  Guide Sequence
ggcuggagugcaguggcgcca

SEQ ID NO: 19885 - RNA, 21 nt, Artificial Sequence
  Guide Sequence
gggaauacccacagugagaau

SEQ ID NO: 19886 - RNA, 21 nt, Artificial Sequence
  Guide Sequence
gggauuaaaggugugagccac

SEQ ID NO: 19887 - RNA, 21 nt, Artificial Sequence
  Guide Sequence
gggauuacaagugugagccac

SEQ ID NO: 19888 - RNA, 21 nt, Artificial Sequence
  Guide Sequence
gggcaugaggaagaggcgcuu

SEQ ID NO: 19889 - RNA, 21 nt, Artificial Sequence
  Guide Sequence
ggggaauacccacagugagaa

SEQ ID NO: 19890 - RNA, 21 nt, Artificial Sequence
  Guide Sequence
ggggcaugaggaagaggcgcu

SEQ ID NO: 19891 - RNA, 21 nt, Artificial Sequence
  Guide Sequence
gggggaauacccacagugaga

SEQ ID NO: 19892 - RNA, 21 nt, Artificial Sequence
  Guide Sequence
ggggugcccaccugugguggg

SEQ ID NO: 19893 - RNA, 21 nt, Artificial Sequence
  Guide Sequence
ggguaguuagguagcuguuac

SEQ ID NO: 19894 - RNA, 21 nt, Artificial Sequence
  Guide Sequence
gggucucuugauuguucuuca

SEQ ID NO: 19895 - RNA, 21 nt, Artificial Sequence
  Guide Sequence
gggucucuuuuuugagucucu

SEQ ID NO: 19896 - RNA, 21 nt, Artificial Sequence
  Guide Sequence
gggugcccaccuguggugggu

SEQ ID NO: 19897 - RNA, 21 nt, Artificial Sequence
  Guide Sequence
ggguucaaaugauucuccugc

SEQ ID NO: 19898 - RNA, 21 nt, Artificial Sequence
  Guide Sequence
gguagcuguuacaaagugccc

SEQ ID NO: 19899 - RNA, 21 nt, Artificial Sequence
  Guide Sequence
gguaguuagguagcuguuaca

SEQ ID NO: 19900 - RNA, 21 nt, Artificial Sequence
  Guide Sequence
ggucucuugauuguucuucag

SEQ ID NO: 19901 - RNA, 21 nt, Artificial Sequence
  Guide Sequence
ggucucuuuuuugagucucuu

SEQ ID NO: 19902 - RNA, 21 nt, Artificial Sequence
  Guide Sequence
ggucugggucucuuuuuugag

SEQ ID NO: 19903 - RNA, 21 nt, Artificial Sequence
  Guide Sequence
ggucugguuugggucucuuga

SEQ ID NO: 19904 - RNA, 21 nt, Artificial Sequence
  Guide Sequence
ggugcccaccuguggugggua

SEQ ID NO: 19905 - RNA, 21 nt, Artificial Sequence
  Guide Sequence
gguggguaguuagguagcugu

SEQ ID NO: 19906 - RNA, 21 nt, Artificial Sequence
  Guide Sequence
ggugugagccacugugccugg

SEQ ID NO: 19907 - RNA, 21 nt, Artificial Sequence
  Guide Sequence
gguucaaaugauucuccugcc

SEQ ID NO: 19908 - RNA, 21 nt, Artificial Sequence
  Guide Sequence
gguuugggucucuugauuguu

SEQ ID NO: 19909 - RNA, 21 nt, Artificial Sequence
  Guide Sequence
guagcuguuacaaagugcccc

SEQ ID NO: 19910 - RNA, 21 nt, Artificial Sequence
  Guide Sequence
guaguuagguagcuguuacaa

SEQ ID NO: 19911 - RNA, 21 nt, Artificial Sequence
  Guide Sequence
gucgcccaggcuggagugcag

SEQ ID NO: 19912 - RNA, 21 nt, Artificial Sequence
  Guide Sequence
gucucuugauuguucuucagg

SEQ ID NO: 19913 - RNA, 21 nt, Artificial Sequence
  Guide Sequence
gucucuugcucugucgcccag

SEQ ID NO: 19914 - RNA, 21 nt, Artificial Sequence
  Guide Sequence
gucucuuuuuugagucucuug

SEQ ID NO: 19915 - RNA, 21 nt, Artificial Sequence
  Guide Sequence
gucugggucucuuuuuugagu

SEQ ID NO: 19916 - RNA, 21 nt, Artificial Sequence
  Guide Sequence
gucugguuugggucucuugau

SEQ ID NO: 19917 - RNA, 21 nt, Artificial Sequence
  Guide Sequence
gucugugaaaugggggaauac

SEQ ID NO: 19918 - RNA, 21 nt, Artificial Sequence
  Guide Sequence
gugaaaugggggaauacccac

SEQ ID NO: 19919 - RNA, 21 nt, Artificial Sequence
  Guide Sequence
gugagaauuagaugagauaga

SEQ ID NO: 19920 - RNA, 21 nt, Artificial Sequence
  Guide Sequence
gugagccacugugccuggcca

SEQ ID NO: 19921 - RNA, 21 nt, Artificial Sequence
  Guide Sequence
gugagccacugugccuggucu

SEQ ID NO: 19922 - RNA, 21 nt, Artificial Sequence
  Guide Sequence
gugcaguggcgccaucucagc

SEQ ID NO: 19923 - RNA, 21 nt, Artificial Sequence
  Guide Sequence
gugcccaccugugguggguag

SEQ ID NO: 19924 - RNA, 21 nt, Artificial Sequence
  Guide Sequence
gugccccagcagagacccccu

SEQ ID NO: 19925 - RNA, 21 nt, Artificial Sequence
  Guide Sequence
gugccuggucugguuuggguc

SEQ ID NO: 19926 - RNA, 21 nt, Artificial Sequence
  Guide Sequence
gugcugggauuaaagguguga

SEQ ID NO: 19927 - RNA, 21 nt, Artificial Sequence
  Guide Sequence
gugcugggauuacaaguguga

SEQ ID NO: 19928 - RNA, 21 nt, Artificial Sequence
  Guide Sequence
guggcgccaucucagcucacu

SEQ ID NO: 19929 - RNA, 21 nt, Artificial Sequence
  Guide Sequence
guggguaguuagguagcuguu

SEQ ID NO: 19930 - RNA, 21 nt, Artificial Sequence
  Guide Sequence
gugguggguaguuagguagcu

SEQ ID NO: 19931 - RNA, 21 nt, Artificial Sequence
  Guide Sequence
gugugagccacugugccuggc

SEQ ID NO: 19932 - RNA, 21 nt, Artificial Sequence
  Guide Sequence
gugugagccacugugccuggu

SEQ ID NO: 19933 - RNA, 21 nt, Artificial Sequence
  Guide Sequence
guuacaaagugccccagcaga

SEQ ID NO: 19934 - RNA, 21 nt, Artificial Sequence
  Guide Sequence
guuagguagcuguuacaaagu

SEQ ID NO: 19935 - RNA, 21 nt, Artificial Sequence
  Guide Sequence
guucaaaugauucuccugccu

SEQ ID NO: 19936 - RNA, 21 nt, Artificial Sequence
  Guide Sequence
guucuucaggggcaugaggaa

SEQ ID NO: 19937 - RNA, 21 nt, Artificial Sequence
  Guide Sequence
guuuccacgucugugaaaugg

SEQ ID NO: 19938 - RNA, 21 nt, Artificial Sequence
  Guide Sequence
guuugggucucuugauuguuc

SEQ ID NO: 19939 - RNA, 21 nt, Artificial Sequence
  Guide Sequence
uaaaggugugagccacugugc

SEQ ID NO: 19940 - RNA, 21 nt, Artificial Sequence
  Guide Sequence
uacaaagugccccagcagaga

SEQ ID NO: 19941 - RNA, 21 nt, Artificial Sequence
  Guide Sequence
uacaagugugagccacugugc

SEQ ID NO: 19942 - RNA, 21 nt, Artificial Sequence
  Guide Sequence
uacccacagugagaauuagau

SEQ ID NO: 19943 - RNA, 21 nt, Artificial Sequence
  Guide Sequence
uagaugagauagaugcauuug

SEQ ID NO: 19944 - RNA, 21 nt, Artificial Sequence
  Guide Sequence
uagaugcauuugaaaccacaa

SEQ ID NO: 19945 - RNA, 21 nt, Artificial Sequence
  Guide Sequence
uagcuguuacaaagugcccca

SEQ ID NO: 19946 - RNA, 21 nt, Artificial Sequence
  Guide Sequence
uagguagcuguuacaaagugc

SEQ ID NO: 19947 - RNA, 21 nt, Artificial Sequence
  Guide Sequence
uaguuagguagcuguuacaaa

SEQ ID NO: 19948 - RNA, 21 nt, Artificial Sequence
  Guide Sequence
ucaaaugauucuccugccuca

SEQ ID NO: 19949 - RNA, 21 nt, Artificial Sequence
  Guide Sequence
ucacugcaaucuccgccuucu

SEQ ID NO: 19950 - RNA, 21 nt, Artificial Sequence
  Guide Sequence
ucagccucccaaagugcuggg

SEQ ID NO: 19951 - RNA, 21 nt, Artificial Sequence
  Guide Sequence
ucagcucacugcaaucuccgc

SEQ ID NO: 19952 - RNA, 21 nt, Artificial Sequence
  Guide Sequence
ucaggggcaugaggaagaggc

SEQ ID NO: 19953 - RNA, 21 nt, Artificial Sequence
  Guide Sequence
ucaguuuccacgucugugaaa

SEQ ID NO: 19954 - RNA, 21 nt, Artificial Sequence
  Guide Sequence
uccaccugccucggccuucca

SEQ ID NO: 19955 - RNA, 21 nt, Artificial Sequence
  Guide Sequence
uccacgucugugaaauggggg

SEQ ID NO: 19956 - RNA, 21 nt, Artificial Sequence
  Guide Sequence
uccagagugcugggauuaaag

SEQ ID NO: 19957 - RNA, 21 nt, Artificial Sequence
  Guide Sequence
ucccaaagugcugggauuaca

SEQ ID NO: 19958 - RNA, 21 nt, Artificial Sequence
  Guide Sequence
ucccuucccuugggugagggg

SEQ ID NO: 19959 - RNA, 21 nt, Artificial Sequence
  Guide Sequence
ucccuugggugagggggccca

SEQ ID NO: 19960 - RNA, 21 nt, Artificial Sequence
  Guide Sequence
uccgccuucuggguucaaaug

SEQ ID NO: 19961 - RNA, 21 nt, Artificial Sequence
  Guide Sequence
uccucccuucccuugggugag

SEQ ID NO: 19962 - RNA, 21 nt, Artificial Sequence
  Guide Sequence
uccugccucagccucccaaag

SEQ ID NO: 19963 - RNA, 21 nt, Artificial Sequence
  Guide Sequence
uccuggucugggucucuuuuu

SEQ ID NO: 19964 - RNA, 21 nt, Artificial Sequence
  Guide Sequence
ucgcccaggcuggagugcagu

SEQ ID NO: 19965 - RNA, 21 nt, Artificial Sequence
  Guide Sequence
ucggccuuccagagugcuggg

SEQ ID NO: 19966 - RNA, 21 nt, Artificial Sequence
  Guide Sequence
ucggggugcccaccuguggug

SEQ ID NO: 19967 - RNA, 21 nt, Artificial Sequence
  Guide Sequence
ucucagcucacugcaaucucc

SEQ ID NO: 19968 - RNA, 21 nt, Artificial Sequence
  Guide Sequence
ucuccgccuucuggguucaaa

SEQ ID NO: 19969 - RNA, 21 nt, Artificial Sequence
  Guide Sequence
ucuccugccucagccucccaa

SEQ ID NO: 19970 - RNA, 21 nt, Artificial Sequence
  Guide Sequence
ucucuugauuguucuucaggg

SEQ ID NO: 19971 - RNA, 21 nt, Artificial Sequence
  Guide Sequence
ucucuugcucugucgcccagg

SEQ ID NO: 19972 - RNA, 21 nt, Artificial Sequence
  Guide Sequence
ucucuuuuuugagucucuugc

SEQ ID NO: 19973 - RNA, 21 nt, Artificial Sequence
  Guide Sequence
ucugggucucuuuuuugaguc

SEQ ID NO: 19974 - RNA, 21 nt, Artificial Sequence
  Guide Sequence
ucuggguucaaaugauucucc

SEQ ID NO: 19975 - RNA, 21 nt, Artificial Sequence
  Guide Sequence
ucugguuugggucucuugauu

SEQ ID NO: 19976 - RNA, 21 nt, Artificial Sequence
  Guide Sequence
ucugucgcccaggcuggagug

SEQ ID NO: 19977 - RNA, 21 nt, Artificial Sequence
  Guide Sequence
ucugugaaaugggggaauacc

SEQ ID NO: 19978 - RNA, 21 nt, Artificial Sequence
  Guide Sequence
ucuucaggggcaugaggaaga

SEQ ID NO: 19979 - RNA, 21 nt, Artificial Sequence
  Guide Sequence
ucuugauuguucuucaggggc

SEQ ID NO: 19980 - RNA, 21 nt, Artificial Sequence
  Guide Sequence
ucuugcucugucgcccaggcu

SEQ ID NO: 19981 - RNA, 21 nt, Artificial Sequence
  Guide Sequence
ucuuuuuugagucucuugcuc

SEQ ID NO: 19982 - RNA, 21 nt, Artificial Sequence
  Guide Sequence
ugaaaccacaaaucggggugc

SEQ ID NO: 19983 - RNA, 21 nt, Artificial Sequence
  Guide Sequence
ugaaaugggggaauacccaca

SEQ ID NO: 19984 - RNA, 21 nt, Artificial Sequence
  Guide Sequence
ugagauagaugcauuugaaac

SEQ ID NO: 19985 - RNA, 21 nt, Artificial Sequence
  Guide Sequence
ugagccacugugccuggccac

SEQ ID NO: 19986 - RNA, 21 nt, Artificial Sequence
  Guide Sequence
ugagccacugugccuggucug

SEQ ID NO: 19987 - RNA, 21 nt, Artificial Sequence
  Guide Sequence
ugaggaagaggcgcuuccucc

SEQ ID NO: 19988 - RNA, 21 nt, Artificial Sequence
  Guide Sequence
ugagucucuugcucugucgcc

SEQ ID NO: 19989 - RNA, 21 nt, Artificial Sequence
  Guide Sequence
ugauccaccugccucggccuu

SEQ ID NO: 19990 - RNA, 21 nt, Artificial Sequence
  Guide Sequence
ugauucuccugccucagccuc

SEQ ID NO: 19991 - RNA, 21 nt, Artificial Sequence
  Guide Sequence
ugauuguucuucaggggcaug

SEQ ID NO: 19992 - RNA, 21 nt, Artificial Sequence
  Guide Sequence
ugcaaucuccgccuucugggu

SEQ ID NO: 19993 - RNA, 21 nt, Artificial Sequence
  Guide Sequence
ugcaguggcgccaucucagcu

SEQ ID NO: 19994 - RNA, 21 nt, Artificial Sequence
  Guide Sequence
ugcauuugaaaccacaaaucg

SEQ ID NO: 19995 - RNA, 21 nt, Artificial Sequence
  Guide Sequence
ugcccaccugugguggguagu

SEQ ID NO: 19996 - RNA, 21 nt, Artificial Sequence
  Guide Sequence
ugccccagcagagacccccuu

SEQ ID NO: 19997 - RNA, 21 nt, Artificial Sequence
  Guide Sequence
ugccucagccucccaaagugc

SEQ ID NO: 19998 - RNA, 21 nt, Artificial Sequence
  Guide Sequence
ugccucggccuuccagagugc

SEQ ID NO: 19999 - RNA, 21 nt, Artificial Sequence
  Guide Sequence
ugccuggucugguuugggucu

SEQ ID NO: 20000 - RNA, 21 nt, Artificial Sequence
  Guide Sequence
ugcucugucgcccaggcugga

SEQ ID NO: 20001 - RNA, 21 nt, Artificial Sequence
  Guide Sequence
ugcugggauuaaaggugugag

SEQ ID NO: 20002 - RNA, 21 nt, Artificial Sequence
  Guide Sequence
ugcugggauuacaagugugag

SEQ ID NO: 20003 - RNA, 21 nt, Artificial Sequence
  Guide Sequence
uggagugcaguggcgccaucu

SEQ ID NO: 20004 - RNA, 21 nt, Artificial Sequence
  Guide Sequence
uggcgccaucucagcucacug

SEQ ID NO: 20005 - RNA, 21 nt, Artificial Sequence
  Guide Sequence
ugggauuaaaggugugagcca

SEQ ID NO: 20006 - RNA, 21 nt, Artificial Sequence
  Guide Sequence
ugggauuacaagugugagcca

SEQ ID NO: 20007 - RNA, 21 nt, Artificial Sequence
  Guide Sequence
ugggggaauacccacagugag

SEQ ID NO: 20008 - RNA, 21 nt, Artificial Sequence
  Guide Sequence
uggguaguuagguagcuguua

SEQ ID NO: 20009 - RNA, 21 nt, Artificial Sequence
  Guide Sequence
ugggucucuugauuguucuuc

SEQ ID NO: 20010 - RNA, 21 nt, Artificial Sequence
  Guide Sequence
ugggucucuuuuuugagucuc

SEQ ID NO: 20011 - RNA, 21 nt, Artificial Sequence
  Guide Sequence
uggguucaaaugauucuccug

SEQ ID NO: 20012 - RNA, 21 nt, Artificial Sequence
  Guide Sequence
uggucugggucucuuuuuuga

SEQ ID NO: 20013 - RNA, 21 nt, Artificial Sequence
  Guide Sequence
uggucugguuugggucucuug

SEQ ID NO: 20014 - RNA, 21 nt, Artificial Sequence
  Guide Sequence
ugguggguaguuagguagcug

SEQ ID NO: 20015 - RNA, 21 nt, Artificial Sequence
  Guide Sequence
ugguuugggucucuugauugu

SEQ ID NO: 20016 - RNA, 21 nt, Artificial Sequence
  Guide Sequence
ugucgcccaggcuggagugca

SEQ ID NO: 20017 - RNA, 21 nt, Artificial Sequence
  Guide Sequence
ugugaaaugggggaauaccca

SEQ ID NO: 20018 - RNA, 21 nt, Artificial Sequence
  Guide Sequence
ugugagccacugugccuggcc

SEQ ID NO: 20019 - RNA, 21 nt, Artificial Sequence
  Guide Sequence
ugugagccacugugccugguc

SEQ ID NO: 20020 - RNA, 21 nt, Artificial Sequence
  Guide Sequence
ugugccuggucugguuugggu

SEQ ID NO: 20021 - RNA, 21 nt, Artificial Sequence
  Guide Sequence
ugugguggguaguuagguagc

SEQ ID NO: 20022 - RNA, 21 nt, Artificial Sequence
  Guide Sequence
uguuacaaagugccccagcag

SEQ ID NO: 20023 - RNA, 21 nt, Artificial Sequence
  Guide Sequence
uguucuucaggggcaugagga

SEQ ID NO: 20024 - RNA, 21 nt, Artificial Sequence
  Guide Sequence
uuaaaggugugagccacugug

SEQ ID NO: 20025 - RNA, 21 nt, Artificial Sequence
  Guide Sequence
uuacaaagugccccagcagag

SEQ ID NO: 20026 - RNA, 21 nt, Artificial Sequence
  Guide Sequence
uuacaagugugagccacugug

SEQ ID NO: 20027 - RNA, 21 nt, Artificial Sequence
  Guide Sequence
uuagguagcuguuacaaagug

SEQ ID NO: 20028 - RNA, 21 nt, Artificial Sequence
  Guide Sequence
uucaaaugauucuccugccuc

SEQ ID NO: 20029 - RNA, 21 nt, Artificial Sequence
  Guide Sequence
uucaggggcaugaggaagagg

SEQ ID NO: 20030 - RNA, 21 nt, Artificial Sequence
  Guide Sequence
uuccacgucugugaaaugggg

SEQ ID NO: 20031 - RNA, 21 nt, Artificial Sequence
  Guide Sequence
uuccagagugcugggauuaaa

SEQ ID NO: 20032 - RNA, 21 nt, Artificial Sequence
  Guide Sequence
uucccuugggugagggggccc

SEQ ID NO: 20033 - RNA, 21 nt, Artificial Sequence
  Guide Sequence
uuccucccuucccuuggguga

SEQ ID NO: 20034 - RNA, 21 nt, Artificial Sequence
  Guide Sequence
uucuccugccucagccuccca

SEQ ID NO: 20035 - RNA, 21 nt, Artificial Sequence
  Guide Sequence
uucuggguucaaaugauucuc

SEQ ID NO: 20036 - RNA, 21 nt, Artificial Sequence
  Guide Sequence
uucuucaggggcaugaggaag

SEQ ID NO: 20037 - RNA, 21 nt, Artificial Sequence
  Guide Sequence
uugaaaccacaaaucggggug

SEQ ID NO: 20038 - RNA, 21 nt, Artificial Sequence
  Guide Sequence
uugagucucuugcucugucgc

SEQ ID NO: 20039 - RNA, 21 nt, Artificial Sequence
  Guide Sequence
uugauuguucuucaggggcau

SEQ ID NO: 20040 - RNA, 21 nt, Artificial Sequence
  Guide Sequence
uugcucugucgcccaggcugg

SEQ ID NO: 20041 - RNA, 21 nt, Artificial Sequence
  Guide Sequence
uugggucucuugauuguucuu

SEQ ID NO: 20042 - RNA, 21 nt, Artificial Sequence
  Guide Sequence
uuguucuucaggggcaugagg

SEQ ID NO: 20043 - RNA, 21 nt, Artificial Sequence
  Guide Sequence
uuuccacgucugugaaauggg

SEQ ID NO: 20044 - RNA, 21 nt, Artificial Sequence
  Guide Sequence
uuugaaaccacaaaucggggu

SEQ ID NO: 20045 - RNA, 21 nt, Artificial Sequence
  Guide Sequence
uuugagucucuugcucugucg

SEQ ID NO: 20046 - RNA, 21 nt, Artificial Sequence
  Guide Sequence
uuugggucucuugauuguucu

SEQ ID NO: 20047 - RNA, 21 nt, Artificial Sequence
  Guide Sequence
uuuugagucucuugcucuguc

SEQ ID NO: 20048 - RNA, 21 nt, Artificial Sequence
  Guide Sequence
uuuuugagucucuugcucugu

SEQ ID NO: 20049 - RNA, 21 nt, Artificial Sequence
  Guide Sequence
uuuuuugagucucuugcucug

SEQ ID NO: 20050 - RNA, 22 nt, Artificial Sequence
  Guide Sequence
aaaccacaaaucggggugccca

SEQ ID NO: 20051 - RNA, 22 nt, Artificial Sequence
  Guide Sequence
aaaggugugagccacugugccu

SEQ ID NO: 20052 - RNA, 22 nt, Artificial Sequence
  Guide Sequence
aaagugccccagcagagacccc

SEQ ID NO: 20053 - RNA, 22 nt, Artificial Sequence
  Guide Sequence
aaagugcugggauuacaagugu

SEQ ID NO: 20054 - RNA, 22 nt, Artificial Sequence
  Guide Sequence
aaaucggggugcccaccugugg

SEQ ID NO: 20055 - RNA, 22 nt, Artificial Sequence
  Guide Sequence
aaaugauucuccugccucagcc

SEQ ID NO: 20056 - RNA, 22 nt, Artificial Sequence
  Guide Sequence
aaaugggggaauacccacagug

SEQ ID NO: 20057 - RNA, 22 nt, Artificial Sequence
  Guide Sequence
aaccacaaaucggggugcccac

SEQ ID NO: 20058 - RNA, 22 nt, Artificial Sequence
  Guide Sequence
aagaggcgcuuccucccuuccc

SEQ ID NO: 20059 - RNA, 22 nt, Artificial Sequence
  Guide Sequence
aaggugugagccacugugccug

SEQ ID NO: 20060 - RNA, 22 nt, Artificial Sequence
  Guide Sequence
aagugccccagcagagaccccc

SEQ ID NO: 20061 - RNA, 22 nt, Artificial Sequence
  Guide Sequence
aagugcugggauuacaagugug

SEQ ID NO: 20062 - RNA, 22 nt, Artificial Sequence
  Guide Sequence
aagugugagccacugugccugg

SEQ ID NO: 20063 - RNA, 22 nt, Artificial Sequence
  Guide Sequence
aauacccacagugagaauuaga

SEQ ID NO: 20064 - RNA, 22 nt, Artificial Sequence
  Guide Sequence
aaucggggugcccaccuguggu

SEQ ID NO: 20065 - RNA, 22 nt, Artificial Sequence
  Guide Sequence
aaucuccgccuucuggguucaa

SEQ ID NO: 20066 - RNA, 22 nt, Artificial Sequence
  Guide Sequence
aaugauucuccugccucagccu

SEQ ID NO: 20067 - RNA, 22 nt, Artificial Sequence
  Guide Sequence
aaugggggaauacccacaguga

SEQ ID NO: 20068 - RNA, 22 nt, Artificial Sequence
  Guide Sequence
acaaagugccccagcagagacc

SEQ ID NO: 20069 - RNA, 22 nt, Artificial Sequence
  Guide Sequence
acaaaucggggugcccaccugu

SEQ ID NO: 20070 - RNA, 22 nt, Artificial Sequence
  Guide Sequence
acaagugugagccacugugccu

SEQ ID NO: 20071 - RNA, 22 nt, Artificial Sequence
  Guide Sequence
acagugagaauuagaugagaua

SEQ ID NO: 20072 - RNA, 22 nt, Artificial Sequence
  Guide Sequence
accacaaaucggggugcccacc

SEQ ID NO: 20073 - RNA, 22 nt, Artificial Sequence
  Guide Sequence
acccacagugagaauuagauga

SEQ ID NO: 20074 - RNA, 22 nt, Artificial Sequence
  Guide Sequence
acccccuugacuaacuuuuauu

SEQ ID NO: 20075 - RNA, 22 nt, Artificial Sequence
  Guide Sequence
accugccucggccuuccagagu

SEQ ID NO: 20076 - RNA, 22 nt, Artificial Sequence
  Guide Sequence
accugugguggguaguuaggua

SEQ ID NO: 20077 - RNA, 22 nt, Artificial Sequence
  Guide Sequence
acgucugugaaaugggggaaua

SEQ ID NO: 20078 - RNA, 22 nt, Artificial Sequence
  Guide Sequence
acugcaaucuccgccuucuggg

SEQ ID NO: 20079 - RNA, 22 nt, Artificial Sequence
  Guide Sequence
acugugccuggccacucccuug

SEQ ID NO: 20080 - RNA, 22 nt, Artificial Sequence
  Guide Sequence
acugugccuggucugguuuggg

SEQ ID NO: 20081 - RNA, 22 nt, Artificial Sequence
  Guide Sequence
agaauuagaugagauagaugca

SEQ ID NO: 20082 - RNA, 22 nt, Artificial Sequence
  Guide Sequence
agacccccuugacuaacuuuua

SEQ ID NO: 20083 - RNA, 22 nt, Artificial Sequence
  Guide Sequence
agagacccccuugacuaacuuu

SEQ ID NO: 20084 - RNA, 22 nt, Artificial Sequence
  Guide Sequence
agaggcgcuuccucccuucccu

SEQ ID NO: 20085 - RNA, 22 nt, Artificial Sequence
  Guide Sequence
agagugcugggauuaaaggugu

SEQ ID NO: 20086 - RNA, 22 nt, Artificial Sequence
  Guide Sequence
agauagaugcauuugaaaccac

SEQ ID NO: 20087 - RNA, 22 nt, Artificial Sequence
  Guide Sequence
agaugagauagaugcauuugaa

SEQ ID NO: 20088 - RNA, 22 nt, Artificial Sequence
  Guide Sequence
agaugcauuugaaaccacaaau

SEQ ID NO: 20089 - RNA, 22 nt, Artificial Sequence
  Guide Sequence
agcagagacccccuugacuaac

SEQ ID NO: 20090 - RNA, 22 nt, Artificial Sequence
  Guide Sequence
agccacugugccuggccacucc

SEQ ID NO: 20091 - RNA, 22 nt, Artificial Sequence
  Guide Sequence
agccacugugccuggucugguu

SEQ ID NO: 20092 - RNA, 22 nt, Artificial Sequence
  Guide Sequence
agccucccaaagugcugggauu

SEQ ID NO: 20093 - RNA, 22 nt, Artificial Sequence
  Guide Sequence
agcucacugcaaucuccgccuu

SEQ ID NO: 20094 - RNA, 22 nt, Artificial Sequence
  Guide Sequence
agcuguuacaaagugccccagc

SEQ ID NO: 20095 - RNA, 22 nt, Artificial Sequence
  Guide Sequence
aggaagaggcgcuuccucccuu

SEQ ID NO: 20096 - RNA, 22 nt, Artificial Sequence
  Guide Sequence
aggcgcuuccucccuucccuug

SEQ ID NO: 20097 - RNA, 22 nt, Artificial Sequence
  Guide Sequence
aggcuggagugcaguggcgcca

SEQ ID NO: 20098 - RNA, 22 nt, Artificial Sequence
  Guide Sequence
aggggcaugaggaagaggcgcu

SEQ ID NO: 20099 - RNA, 22 nt, Artificial Sequence
  Guide Sequence
agguagcuguuacaaagugccc

SEQ ID NO: 20100 - RNA, 22 nt, Artificial Sequence
  Guide Sequence
aggugugagccacugugccugg

SEQ ID NO: 20101 - RNA, 22 nt, Artificial Sequence
  Guide Sequence
agucucuugcucugucgcccag

SEQ ID NO: 20102 - RNA, 22 nt, Artificial Sequence
  Guide Sequence
agugagaauuagaugagauaga

SEQ ID NO: 20103 - RNA, 22 nt, Artificial Sequence
  Guide Sequence
agugcaguggcgccaucucagc

SEQ ID NO: 20104 - RNA, 22 nt, Artificial Sequence
  Guide Sequence
agugccccagcagagacccccu

SEQ ID NO: 20105 - RNA, 22 nt, Artificial Sequence
  Guide Sequence
agugcugggauuaaagguguga

SEQ ID NO: 20106 - RNA, 22 nt, Artificial Sequence
  Guide Sequence
agugcugggauuacaaguguga

SEQ ID NO: 20107 - RNA, 22 nt, Artificial Sequence
  Guide Sequence
aguggcgccaucucagcucacu

SEQ ID NO: 20108 - RNA, 22 nt, Artificial Sequence
  Guide Sequence
agugugagccacugugccuggu

SEQ ID NO: 20109 - RNA, 22 nt, Artificial Sequence
  Guide Sequence
aguuagguagcuguuacaaagu

SEQ ID NO: 20110 - RNA, 22 nt, Artificial Sequence
  Guide Sequence
aguuuccacgucugugaaaugg

SEQ ID NO: 20111 - RNA, 22 nt, Artificial Sequence
  Guide Sequence
auacccacagugagaauuagau

SEQ ID NO: 20112 - RNA, 22 nt, Artificial Sequence
  Guide Sequence
auagaugcauuugaaaccacaa

SEQ ID NO: 20113 - RNA, 22 nt, Artificial Sequence
  Guide Sequence
auccaccugccucggccuucca

SEQ ID NO: 20114 - RNA, 22 nt, Artificial Sequence
  Guide Sequence
auccuggucugggucucuuuuu

SEQ ID NO: 20115 - RNA, 22 nt, Artificial Sequence
  Guide Sequence
aucggggugcccaccuguggug

SEQ ID NO: 20116 - RNA, 22 nt, Artificial Sequence
  Guide Sequence
aucucagcucacugcaaucucc

SEQ ID NO: 20117 - RNA, 22 nt, Artificial Sequence
  Guide Sequence
aucuccgccuucuggguucaaa

SEQ ID NO: 20118 - RNA, 22 nt, Artificial Sequence
  Guide Sequence
augagauagaugcauuugaaac

SEQ ID NO: 20119 - RNA, 22 nt, Artificial Sequence
  Guide Sequence
augaggaagaggcgcuuccucc

SEQ ID NO: 20120 - RNA, 22 nt, Artificial Sequence
  Guide Sequence
augauucuccugccucagccuc

SEQ ID NO: 20121 - RNA, 22 nt, Artificial Sequence
  Guide Sequence
augcauuugaaaccacaaaucg

SEQ ID NO: 20122 - RNA, 22 nt, Artificial Sequence
  Guide Sequence
augggggaauacccacagugag

SEQ ID NO: 20123 - RNA, 22 nt, Artificial Sequence
  Guide Sequence
auuaaaggugugagccacugug

SEQ ID NO: 20124 - RNA, 22 nt, Artificial Sequence
  Guide Sequence
auuacaagugugagccacugug

SEQ ID NO: 20125 - RNA, 22 nt, Artificial Sequence
  Guide Sequence
auucuccugccucagccuccca

SEQ ID NO: 20126 - RNA, 22 nt, Artificial Sequence
  Guide Sequence
auuguucuucaggggcaugagg

SEQ ID NO: 20127 - RNA, 22 nt, Artificial Sequence
  Guide Sequence
auuugaaaccacaaaucggggu

SEQ ID NO: 20128 - RNA, 22 nt, Artificial Sequence
  Guide Sequence
caaagugccccagcagagaccc

SEQ ID NO: 20129 - RNA, 22 nt, Artificial Sequence
  Guide Sequence
caaagugcugggauuacaagug

SEQ ID NO: 20130 - RNA, 22 nt, Artificial Sequence
  Guide Sequence
caaaucggggugcccaccugug

SEQ ID NO: 20131 - RNA, 22 nt, Artificial Sequence
  Guide Sequence
caaaugauucuccugccucagc

SEQ ID NO: 20132 - RNA, 22 nt, Artificial Sequence
  Guide Sequence
caagugugagccacugugccug

SEQ ID NO: 20133 - RNA, 22 nt, Artificial Sequence
  Guide Sequence
caaucuccgccuucuggguuca

SEQ ID NO: 20134 - RNA, 22 nt, Artificial Sequence
  Guide Sequence
cacaaaucggggugcccaccug

SEQ ID NO: 20135 - RNA, 22 nt, Artificial Sequence
  Guide Sequence
cacagugagaauuagaugagau

SEQ ID NO: 20136 - RNA, 22 nt, Artificial Sequence
  Guide Sequence
caccugccucggccuuccagag

SEQ ID NO: 20137 - RNA, 22 nt, Artificial Sequence
  Guide Sequence
caccugugguggguaguuaggu

SEQ ID NO: 20138 - RNA, 22 nt, Artificial Sequence
  Guide Sequence
cacgucugugaaaugggggaau

SEQ ID NO: 20139 - RNA, 22 nt, Artificial Sequence
  Guide Sequence
cacugcaaucuccgccuucugg

SEQ ID NO: 20140 - RNA, 22 nt, Artificial Sequence
  Guide Sequence
cacugugccuggccacucccuu

SEQ ID NO: 20141 - RNA, 22 nt, Artificial Sequence
  Guide Sequence
cacugugccuggucugguuugg

SEQ ID NO: 20142 - RNA, 22 nt, Artificial Sequence
  Guide Sequence
cagagacccccuugacuaacuu

SEQ ID NO: 20143 - RNA, 22 nt, Artificial Sequence
  Guide Sequence
cagagugcugggauuaaaggug

SEQ ID NO: 20144 - RNA, 22 nt, Artificial Sequence
  Guide Sequence
cagcagagacccccuugacuaa

SEQ ID NO: 20145 - RNA, 22 nt, Artificial Sequence
  Guide Sequence
cagccucccaaagugcugggau

SEQ ID NO: 20146 - RNA, 22 nt, Artificial Sequence
  Guide Sequence
cagcucacugcaaucuccgccu

SEQ ID NO: 20147 - RNA, 22 nt, Artificial Sequence
  Guide Sequence
caggcuggagugcaguggcgcc

SEQ ID NO: 20148 - RNA, 22 nt, Artificial Sequence
  Guide Sequence
caggggcaugaggaagaggcgc

SEQ ID NO: 20149 - RNA, 22 nt, Artificial Sequence
  Guide Sequence
cagugagaauuagaugagauag

SEQ ID NO: 20150 - RNA, 22 nt, Artificial Sequence
  Guide Sequence
caguggcgccaucucagcucac

SEQ ID NO: 20151 - RNA, 22 nt, Artificial Sequence
  Guide Sequence
caguuuccacgucugugaaaug

SEQ ID NO: 20152 - RNA, 22 nt, Artificial Sequence
  Guide Sequence
caucucagcucacugcaaucuc

SEQ ID NO: 20153 - RNA, 22 nt, Artificial Sequence
  Guide Sequence
caugaggaagaggcgcuuccuc

SEQ ID NO: 20154 - RNA, 22 nt, Artificial Sequence
  Guide Sequence
cauuugaaaccacaaaucgggg

SEQ ID NO: 20155 - RNA, 22 nt, Artificial Sequence
  Guide Sequence
ccaaagugcugggauuacaagu

SEQ ID NO: 20156 - RNA, 22 nt, Artificial Sequence
  Guide Sequence
ccacaaaucggggugcccaccu

SEQ ID NO: 20157 - RNA, 22 nt, Artificial Sequence
  Guide Sequence
ccacagugagaauuagaugaga

SEQ ID NO: 20158 - RNA, 22 nt, Artificial Sequence
  Guide Sequence
ccaccugccucggccuuccaga

SEQ ID NO: 20159 - RNA, 22 nt, Artificial Sequence
  Guide Sequence
ccaccugugguggguaguuagg

SEQ ID NO: 20160 - RNA, 22 nt, Artificial Sequence
  Guide Sequence
ccacgucugugaaaugggggaa

SEQ ID NO: 20161 - RNA, 22 nt, Artificial Sequence
  Guide Sequence
ccacugugccuggccacucccu

SEQ ID NO: 20162 - RNA, 22 nt, Artificial Sequence
  Guide Sequence
ccacugugccuggucugguuug

SEQ ID NO: 20163 - RNA, 22 nt, Artificial Sequence
  Guide Sequence
ccagagugcugggauuaaaggu

SEQ ID NO: 20164 - RNA, 22 nt, Artificial Sequence
  Guide Sequence
ccagcagagacccccuugacua

SEQ ID NO: 20165 - RNA, 22 nt, Artificial Sequence
  Guide Sequence
ccaggcuggagugcaguggcgc

SEQ ID NO: 20166 - RNA, 22 nt, Artificial Sequence
  Guide Sequence
ccaucucagcucacugcaaucu

SEQ ID NO: 20167 - RNA, 22 nt, Artificial Sequence
  Guide Sequence
cccaaagugcugggauuacaag

SEQ ID NO: 20168 - RNA, 22 nt, Artificial Sequence
  Guide Sequence
cccacagugagaauuagaugag

SEQ ID NO: 20169 - RNA, 22 nt, Artificial Sequence
  Guide Sequence
cccaccugugguggguaguuag

SEQ ID NO: 20170 - RNA, 22 nt, Artificial Sequence
  Guide Sequence
cccagcagagacccccuugacu

SEQ ID NO: 20171 - RNA, 22 nt, Artificial Sequence
  Guide Sequence
cccaggcuggagugcaguggcg

SEQ ID NO: 20172 - RNA, 22 nt, Artificial Sequence
  Guide Sequence
ccccagcagagacccccuugac

SEQ ID NO: 20173 - RNA, 22 nt, Artificial Sequence
  Guide Sequence
cccccuugacuaacuuuuauuc

SEQ ID NO: 20174 - RNA, 22 nt, Artificial Sequence
  Guide Sequence
ccccuugacuaacuuuuauucu

SEQ ID NO: 20175 - RNA, 22 nt, Artificial Sequence
  Guide Sequence
cccuucccuugggugagggggc

SEQ ID NO: 20176 - RNA, 22 nt, Artificial Sequence
  Guide Sequence
cccuugacuaacuuuuauucuu

SEQ ID NO: 20177 - RNA, 22 nt, Artificial Sequence
  Guide Sequence
cccuugggugagggggcccagg

SEQ ID NO: 20178 - RNA, 22 nt, Artificial Sequence
  Guide Sequence
ccgccuucuggguucaaaugau

SEQ ID NO: 20179 - RNA, 22 nt, Artificial Sequence
  Guide Sequence
ccucagccucccaaagugcugg

SEQ ID NO: 20180 - RNA, 22 nt, Artificial Sequence
  Guide Sequence
ccucccaaagugcugggauuac

SEQ ID NO: 20181 - RNA, 22 nt, Artificial Sequence
  Guide Sequence
ccucccuucccuugggugaggg

SEQ ID NO: 20182 - RNA, 22 nt, Artificial Sequence
  Guide Sequence
ccucggccuuccagagugcugg

SEQ ID NO: 20183 - RNA, 22 nt, Artificial Sequence
  Guide Sequence
ccugccucagccucccaaagug

SEQ ID NO: 20184 - RNA, 22 nt, Artificial Sequence
  Guide Sequence
ccugccucggccuuccagagug

SEQ ID NO: 20185 - RNA, 22 nt, Artificial Sequence
  Guide Sequence
ccuggucugggucucuuuuuug

SEQ ID NO: 20186 - RNA, 22 nt, Artificial Sequence
  Guide Sequence
ccuggucugguuugggucucuu

SEQ ID NO: 20187 - RNA, 22 nt, Artificial Sequence
  Guide Sequence
ccugugguggguaguuagguag

SEQ ID NO: 20188 - RNA, 22 nt, Artificial Sequence
  Guide Sequence
ccuuccagagugcugggauuaa

SEQ ID NO: 20189 - RNA, 22 nt, Artificial Sequence
  Guide Sequence
ccuucccuugggugagggggcc

SEQ ID NO: 20190 - RNA, 22 nt, Artificial Sequence
  Guide Sequence
ccuucuggguucaaaugauucu

SEQ ID NO: 20191 - RNA, 22 nt, Artificial Sequence
  Guide Sequence
ccuugacuaacuuuuauucuuc

SEQ ID NO: 20192 - RNA, 22 nt, Artificial Sequence
  Guide Sequence
ccuugggugagggggcccaggg

SEQ ID NO: 20193 - RNA, 22 nt, Artificial Sequence
  Guide Sequence
cgccaucucagcucacugcaau

SEQ ID NO: 20194 - RNA, 22 nt, Artificial Sequence
  Guide Sequence
cgcccaggcuggagugcagugg

SEQ ID NO: 20195 - RNA, 22 nt, Artificial Sequence
  Guide Sequence
cgccuucuggguucaaaugauu

SEQ ID NO: 20196 - RNA, 22 nt, Artificial Sequence
  Guide Sequence
cgcuuccucccuucccuugggu

SEQ ID NO: 20197 - RNA, 22 nt, Artificial Sequence
  Guide Sequence
cggccuuccagagugcugggau

SEQ ID NO: 20198 - RNA, 22 nt, Artificial Sequence
  Guide Sequence
cggggugcccaccugugguggg

SEQ ID NO: 20199 - RNA, 22 nt, Artificial Sequence
  Guide Sequence
cgucugugaaaugggggaauac

SEQ ID NO: 20200 - RNA, 22 nt, Artificial Sequence
  Guide Sequence
cucacugcaaucuccgccuucu

SEQ ID NO: 20201 - RNA, 22 nt, Artificial Sequence
  Guide Sequence
cucagccucccaaagugcuggg

SEQ ID NO: 20202 - RNA, 22 nt, Artificial Sequence
  Guide Sequence
cucagcucacugcaaucuccgc

SEQ ID NO: 20203 - RNA, 22 nt, Artificial Sequence
  Guide Sequence
cucccaaagugcugggauuaca

SEQ ID NO: 20204 - RNA, 22 nt, Artificial Sequence
  Guide Sequence
cucccuucccuugggugagggg

SEQ ID NO: 20205 - RNA, 22 nt, Artificial Sequence
  Guide Sequence
cuccgccuucuggguucaaaug

SEQ ID NO: 20206 - RNA, 22 nt, Artificial Sequence
  Guide Sequence
cuccugccucagccucccaaag

SEQ ID NO: 20207 - RNA, 22 nt, Artificial Sequence
  Guide Sequence
cucggccuuccagagugcuggg

SEQ ID NO: 20208 - RNA, 22 nt, Artificial Sequence
  Guide Sequence
cucugucgcccaggcuggagug

SEQ ID NO: 20209 - RNA, 22 nt, Artificial Sequence
  Guide Sequence
cucuugauuguucuucaggggc

SEQ ID NO: 20210 - RNA, 22 nt, Artificial Sequence
  Guide Sequence
cucuugcucugucgcccaggcu

SEQ ID NO: 20211 - RNA, 22 nt, Artificial Sequence
  Guide Sequence
cucuuuuuugagucucuugcuc

SEQ ID NO: 20212 - RNA, 22 nt, Artificial Sequence
  Guide Sequence
cugcaaucuccgccuucugggu

SEQ ID NO: 20213 - RNA, 22 nt, Artificial Sequence
  Guide Sequence
cugccucagccucccaaagugc

SEQ ID NO: 20214 - RNA, 22 nt, Artificial Sequence
  Guide Sequence
cugccucggccuuccagagugc

SEQ ID NO: 20215 - RNA, 22 nt, Artificial Sequence
  Guide Sequence
cuggagugcaguggcgccaucu

SEQ ID NO: 20216 - RNA, 22 nt, Artificial Sequence
  Guide Sequence
cugggauuaaaggugugagcca

SEQ ID NO: 20217 - RNA, 22 nt, Artificial Sequence
  Guide Sequence
cugggauuacaagugugagcca

SEQ ID NO: 20218 - RNA, 22 nt, Artificial Sequence
  Guide Sequence
cugggucucuuuuuugagucuc

SEQ ID NO: 20219 - RNA, 22 nt, Artificial Sequence
  Guide Sequence
cuggguucaaaugauucuccug

SEQ ID NO: 20220 - RNA, 22 nt, Artificial Sequence
  Guide Sequence
cuggucugggucucuuuuuuga

SEQ ID NO: 20221 - RNA, 22 nt, Artificial Sequence
  Guide Sequence
cuggucugguuugggucucuug

SEQ ID NO: 20222 - RNA, 22 nt, Artificial Sequence
  Guide Sequence
cugguuugggucucuugauugu

SEQ ID NO: 20223 - RNA, 22 nt, Artificial Sequence
  Guide Sequence
cugucgcccaggcuggagugca

SEQ ID NO: 20224 - RNA, 22 nt, Artificial Sequence
  Guide Sequence
cugugaaaugggggaauaccca

SEQ ID NO: 20225 - RNA, 22 nt, Artificial Sequence
  Guide Sequence
cugugccuggucugguuugggu

SEQ ID NO: 20226 - RNA, 22 nt, Artificial Sequence
  Guide Sequence
cugugguggguaguuagguagc

SEQ ID NO: 20227 - RNA, 22 nt, Artificial Sequence
  Guide Sequence
cuguuacaaagugccccagcag

SEQ ID NO: 20228 - RNA, 22 nt, Artificial Sequence
  Guide Sequence
cuucaggggcaugaggaagagg

SEQ ID NO: 20229 - RNA, 22 nt, Artificial Sequence
  Guide Sequence
cuuccagagugcugggauuaaa

SEQ ID NO: 20230 - RNA, 22 nt, Artificial Sequence
  Guide Sequence
cuucccuugggugagggggccc

SEQ ID NO: 20231 - RNA, 22 nt, Artificial Sequence
  Guide Sequence
cuuccucccuucccuuggguga

SEQ ID NO: 20232 - RNA, 22 nt, Artificial Sequence
  Guide Sequence
cuucuggguucaaaugauucuc

SEQ ID NO: 20233 - RNA, 22 nt, Artificial Sequence
  Guide Sequence
cuugacuaacuuuuauucuucc

SEQ ID NO: 20234 - RNA, 22 nt, Artificial Sequence
  Guide Sequence
cuugauuguucuucaggggcau

SEQ ID NO: 20235 - RNA, 22 nt, Artificial Sequence
  Guide Sequence
cuugcucugucgcccaggcugg

SEQ ID NO: 20236 - RNA, 22 nt, Artificial Sequence
  Guide Sequence
cuuuuauucuuccaucuuuucc

SEQ ID NO: 20237 - RNA, 22 nt, Artificial Sequence
  Guide Sequence
cuuuuuugagucucuugcucug

SEQ ID NO: 20238 - RNA, 22 nt, Artificial Sequence
  Guide Sequence
gaaaccacaaaucggggugccc

SEQ ID NO: 20239 - RNA, 22 nt, Artificial Sequence
  Guide Sequence
gaaaugggggaauacccacagu

SEQ ID NO: 20240 - RNA, 22 nt, Artificial Sequence
  Guide Sequence
gaagaggcgcuuccucccuucc

SEQ ID NO: 20241 - RNA, 22 nt, Artificial Sequence
  Guide Sequence
gaauacccacagugagaauuag

SEQ ID NO: 20242 - RNA, 22 nt, Artificial Sequence
  Guide Sequence
gaauuagaugagauagaugcau

SEQ ID NO: 20243 - RNA, 22 nt, Artificial Sequence
  Guide Sequence
gacccccuugacuaacuuuuau

SEQ ID NO: 20244 - RNA, 22 nt, Artificial Sequence
  Guide Sequence
gacuaacuuuuauucuuccauc

SEQ ID NO: 20245 - RNA, 22 nt, Artificial Sequence
  Guide Sequence
gagaauuagaugagauagaugc

SEQ ID NO: 20246 - RNA, 22 nt, Artificial Sequence
  Guide Sequence
gagacccccuugacuaacuuuu

SEQ ID NO: 20247 - RNA, 22 nt, Artificial Sequence
  Guide Sequence
gagauagaugcauuugaaacca

SEQ ID NO: 20248 - RNA, 22 nt, Artificial Sequence
  Guide Sequence
gagccacugugccuggccacuc

SEQ ID NO: 20249 - RNA, 22 nt, Artificial Sequence
  Guide Sequence
gagccacugugccuggucuggu

SEQ ID NO: 20250 - RNA, 22 nt, Artificial Sequence
  Guide Sequence
gaggaagaggcgcuuccucccu

SEQ ID NO: 20251 - RNA, 22 nt, Artificial Sequence
  Guide Sequence
gaggcgcuuccucccuucccuu

SEQ ID NO: 20252 - RNA, 22 nt, Artificial Sequence
  Guide Sequence
gagucucuugcucugucgccca

SEQ ID NO: 20253 - RNA, 22 nt, Artificial Sequence
  Guide Sequence
gagugcaguggcgccaucucag

SEQ ID NO: 20254 - RNA, 22 nt, Artificial Sequence
  Guide Sequence
gagugcugggauuaaaggugug

SEQ ID NO: 20255 - RNA, 22 nt, Artificial Sequence
  Guide Sequence
gauagaugcauuugaaaccaca

SEQ ID NO: 20256 - RNA, 22 nt, Artificial Sequence
  Guide Sequence
gauccaccugccucggccuucc

SEQ ID NO: 20257 - RNA, 22 nt, Artificial Sequence
  Guide Sequence
gaugagauagaugcauuugaaa

SEQ ID NO: 20258 - RNA, 22 nt, Artificial Sequence
  Guide Sequence
gaugcauuugaaaccacaaauc

SEQ ID NO: 20259 - RNA, 22 nt, Artificial Sequence
  Guide Sequence
gauuaaaggugugagccacugu

SEQ ID NO: 20260 - RNA, 22 nt, Artificial Sequence
  Guide Sequence
gauuacaagugugagccacugu

SEQ ID NO: 20261 - RNA, 22 nt, Artificial Sequence
  Guide Sequence
gauucuccugccucagccuccc

SEQ ID NO: 20262 - RNA, 22 nt, Artificial Sequence
  Guide Sequence
gauuguucuucaggggcaugag

SEQ ID NO: 20263 - RNA, 22 nt, Artificial Sequence
  Guide Sequence
gcaaucuccgccuucuggguuc

SEQ ID NO: 20264 - RNA, 22 nt, Artificial Sequence
  Guide Sequence
gcagagacccccuugacuaacu

SEQ ID NO: 20265 - RNA, 22 nt, Artificial Sequence
  Guide Sequence
gcaguggcgccaucucagcuca

SEQ ID NO: 20266 - RNA, 22 nt, Artificial Sequence
  Guide Sequence
gcaugaggaagaggcgcuuccu

SEQ ID NO: 20267 - RNA, 22 nt, Artificial Sequence
  Guide Sequence
gcauuugaaaccacaaaucggg

SEQ ID NO: 20268 - RNA, 22 nt, Artificial Sequence
  Guide Sequence
gccacugugccuggccacuccc

SEQ ID NO: 20269 - RNA, 22 nt, Artificial Sequence
  Guide Sequence
gccacugugccuggucugguuu

SEQ ID NO: 20270 - RNA, 22 nt, Artificial Sequence
  Guide Sequence
gccaucucagcucacugcaauc

SEQ ID NO: 20271 - RNA, 22 nt, Artificial Sequence
  Guide Sequence
gcccaccugugguggguaguua

SEQ ID NO: 20272 - RNA, 22 nt, Artificial Sequence
  Guide Sequence
gcccaggcuggagugcaguggc

SEQ ID NO: 20273 - RNA, 22 nt, Artificial Sequence
  Guide Sequence
gccccagcagagacccccuuga

SEQ ID NO: 20274 - RNA, 22 nt, Artificial Sequence
  Guide Sequence
gccucagccucccaaagugcug

SEQ ID NO: 20275 - RNA, 22 nt, Artificial Sequence
  Guide Sequence
gccucccaaagugcugggauua

SEQ ID NO: 20276 - RNA, 22 nt, Artificial Sequence
  Guide Sequence
gccucggccuuccagagugcug

SEQ ID NO: 20277 - RNA, 22 nt, Artificial Sequence
  Guide Sequence
gccuggucugguuugggucucu

SEQ ID NO: 20278 - RNA, 22 nt, Artificial Sequence
  Guide Sequence
gccuuccagagugcugggauua

SEQ ID NO: 20279 - RNA, 22 nt, Artificial Sequence
  Guide Sequence
gccuucuggguucaaaugauuc

SEQ ID NO: 20280 - RNA, 22 nt, Artificial Sequence
  Guide Sequence
gcgccaucucagcucacugcaa

SEQ ID NO: 20281 - RNA, 22 nt, Artificial Sequence
  Guide Sequence
gcgcuuccucccuucccuuggg

SEQ ID NO: 20282 - RNA, 22 nt, Artificial Sequence
  Guide Sequence
gcucacugcaaucuccgccuuc

SEQ ID NO: 20283 - RNA, 22 nt, Artificial Sequence
  Guide Sequence
gcucugucgcccaggcuggagu

SEQ ID NO: 20284 - RNA, 22 nt, Artificial Sequence
  Guide Sequence
gcuggagugcaguggcgccauc

SEQ ID NO: 20285 - RNA, 22 nt, Artificial Sequence
  Guide Sequence
gcugggauuaaaggugugagcc

SEQ ID NO: 20286 - RNA, 22 nt, Artificial Sequence
  Guide Sequence
gcugggauuacaagugugagcc

SEQ ID NO: 20287 - RNA, 22 nt, Artificial Sequence
  Guide Sequence
gcuguuacaaagugccccagca

SEQ ID NO: 20288 - RNA, 22 nt, Artificial Sequence
  Guide Sequence
gcuuccucccuucccuugggug

SEQ ID NO: 20289 - RNA, 22 nt, Artificial Sequence
  Guide Sequence
ggaagaggcgcuuccucccuuc

SEQ ID NO: 20290 - RNA, 22 nt, Artificial Sequence
  Guide Sequence
ggaauacccacagugagaauua

SEQ ID NO: 20291 - RNA, 22 nt, Artificial Sequence
  Guide Sequence
ggagugcaguggcgccaucuca

SEQ ID NO: 20292 - RNA, 22 nt, Artificial Sequence
  Guide Sequence
ggauuaaaggugugagccacug

SEQ ID NO: 20293 - RNA, 22 nt, Artificial Sequence
  Guide Sequence
ggauuacaagugugagccacug

SEQ ID NO: 20294 - RNA, 22 nt, Artificial Sequence
  Guide Sequence
ggcaugaggaagaggcgcuucc

SEQ ID NO: 20295 - RNA, 22 nt, Artificial Sequence
  Guide Sequence
ggccuuccagagugcugggauu

SEQ ID NO: 20296 - RNA, 22 nt, Artificial Sequence
  Guide Sequence
ggcgccaucucagcucacugca

SEQ ID NO: 20297 - RNA, 22 nt, Artificial Sequence
  Guide Sequence
ggcgcuuccucccuucccuugg

SEQ ID NO: 20298 - RNA, 22 nt, Artificial Sequence
  Guide Sequence
ggcuggagugcaguggcgccau

SEQ ID NO: 20299 - RNA, 22 nt, Artificial Sequence
  Guide Sequence
gggaauacccacagugagaauu

SEQ ID NO: 20300 - RNA, 22 nt, Artificial Sequence
  Guide Sequence
gggauuaaaggugugagccacu

SEQ ID NO: 20301 - RNA, 22 nt, Artificial Sequence
  Guide Sequence
gggauuacaagugugagccacu

SEQ ID NO: 20302 - RNA, 22 nt, Artificial Sequence
  Guide Sequence
gggcaugaggaagaggcgcuuc

SEQ ID NO: 20303 - RNA, 22 nt, Artificial Sequence
  Guide Sequence
ggggaauacccacagugagaau

SEQ ID NO: 20304 - RNA, 22 nt, Artificial Sequence
  Guide Sequence
ggggcaugaggaagaggcgcuu

SEQ ID NO: 20305 - RNA, 22 nt, Artificial Sequence
  Guide Sequence
gggggaauacccacagugagaa

SEQ ID NO: 20306 - RNA, 22 nt, Artificial Sequence
  Guide Sequence
ggggugcccaccuguggugggu

SEQ ID NO: 20307 - RNA, 22 nt, Artificial Sequence
  Guide Sequence
ggguaguuagguagcuguuaca

SEQ ID NO: 20308 - RNA, 22 nt, Artificial Sequence
  Guide Sequence
gggucucuugauuguucuucag

SEQ ID NO: 20309 - RNA, 22 nt, Artificial Sequence
  Guide Sequence
gggucucuuuuuugagucucuu

SEQ ID NO: 20310 - RNA, 22 nt, Artificial Sequence
  Guide Sequence
gggugcccaccuguggugggua

SEQ ID NO: 20311 - RNA, 22 nt, Artificial Sequence
  Guide Sequence
ggguucaaaugauucuccugcc

SEQ ID NO: 20312 - RNA, 22 nt, Artificial Sequence
  Guide Sequence
gguagcuguuacaaagugcccc

SEQ ID NO: 20313 - RNA, 22 nt, Artificial Sequence
  Guide Sequence
gguaguuagguagcuguuacaa

SEQ ID NO: 20314 - RNA, 22 nt, Artificial Sequence
  Guide Sequence
ggucucuugauuguucuucagg

SEQ ID NO: 20315 - RNA, 22 nt, Artificial Sequence
  Guide Sequence
ggucucuuuuuugagucucuug

SEQ ID NO: 20316 - RNA, 22 nt, Artificial Sequence
  Guide Sequence
ggucugggucucuuuuuugagu

SEQ ID NO: 20317 - RNA, 22 nt, Artificial Sequence
  Guide Sequence
ggucugguuugggucucuugau

SEQ ID NO: 20318 - RNA, 22 nt, Artificial Sequence
  Guide Sequence
ggugcccaccugugguggguag

SEQ ID NO: 20319 - RNA, 22 nt, Artificial Sequence
  Guide Sequence
gguggguaguuagguagcuguu

SEQ ID NO: 20320 - RNA, 22 nt, Artificial Sequence
  Guide Sequence
ggugugagccacugugccuggc

SEQ ID NO: 20321 - RNA, 22 nt, Artificial Sequence
  Guide Sequence
gguucaaaugauucuccugccu

SEQ ID NO: 20322 - RNA, 22 nt, Artificial Sequence
  Guide Sequence
gguuugggucucuugauuguuc

SEQ ID NO: 20323 - RNA, 22 nt, Artificial Sequence
  Guide Sequence
guagcuguuacaaagugcccca

SEQ ID NO: 20324 - RNA, 22 nt, Artificial Sequence
  Guide Sequence
guaguuagguagcuguuacaaa

SEQ ID NO: 20325 - RNA, 22 nt, Artificial Sequence
  Guide Sequence
gucgcccaggcuggagugcagu

SEQ ID NO: 20326 - RNA, 22 nt, Artificial Sequence
  Guide Sequence
gucucuugauuguucuucaggg

SEQ ID NO: 20327 - RNA, 22 nt, Artificial Sequence
  Guide Sequence
gucucuugcucugucgcccagg

SEQ ID NO: 20328 - RNA, 22 nt, Artificial Sequence
  Guide Sequence
gucucuuuuuugagucucuugc

SEQ ID NO: 20329 - RNA, 22 nt, Artificial Sequence
  Guide Sequence
gucugggucucuuuuuugaguc

SEQ ID NO: 20330 - RNA, 22 nt, Artificial Sequence
  Guide Sequence
gucugguuugggucucuugauu

SEQ ID NO: 20331 - RNA, 22 nt, Artificial Sequence
  Guide Sequence
gucugugaaaugggggaauacc

SEQ ID NO: 20332 - RNA, 22 nt, Artificial Sequence
  Guide Sequence
gugaaaugggggaauacccaca

SEQ ID NO: 20333 - RNA, 22 nt, Artificial Sequence
  Guide Sequence
gugagaauuagaugagauagau

SEQ ID NO: 20334 - RNA, 22 nt, Artificial Sequence
  Guide Sequence
gugagccacugugccuggccac

SEQ ID NO: 20335 - RNA, 22 nt, Artificial Sequence
  Guide Sequence
gugagccacugugccuggucug

SEQ ID NO: 20336 - RNA, 22 nt, Artificial Sequence
  Guide Sequence
gugcaguggcgccaucucagcu

SEQ ID NO: 20337 - RNA, 22 nt, Artificial Sequence
  Guide Sequence
gugcccaccugugguggguagu

SEQ ID NO: 20338 - RNA, 22 nt, Artificial Sequence
  Guide Sequence
gugccccagcagagacccccuu

SEQ ID NO: 20339 - RNA, 22 nt, Artificial Sequence
  Guide Sequence
gugccuggucugguuugggucu

SEQ ID NO: 20340 - RNA, 22 nt, Artificial Sequence
  Guide Sequence
gugcugggauuaaaggugugag

SEQ ID NO: 20341 - RNA, 22 nt, Artificial Sequence
  Guide Sequence
gugcugggauuacaagugugag

SEQ ID NO: 20342 - RNA, 22 nt, Artificial Sequence
  Guide Sequence
guggcgccaucucagcucacug

SEQ ID NO: 20343 - RNA, 22 nt, Artificial Sequence
  Guide Sequence
guggguaguuagguagcuguua

SEQ ID NO: 20344 - RNA, 22 nt, Artificial Sequence
  Guide Sequence
gugguggguaguuagguagcug

SEQ ID NO: 20345 - RNA, 22 nt, Artificial Sequence
  Guide Sequence
gugugagccacugugccuggcc

SEQ ID NO: 20346 - RNA, 22 nt, Artificial Sequence
  Guide Sequence
gugugagccacugugccugguc

SEQ ID NO: 20347 - RNA, 22 nt, Artificial Sequence
  Guide Sequence
guuacaaagugccccagcagag

SEQ ID NO: 20348 - RNA, 22 nt, Artificial Sequence
  Guide Sequence
guuagguagcuguuacaaagug

SEQ ID NO: 20349 - RNA, 22 nt, Artificial Sequence
  Guide Sequence
guucaaaugauucuccugccuc

SEQ ID NO: 20350 - RNA, 22 nt, Artificial Sequence
  Guide Sequence
guucuucaggggcaugaggaag

SEQ ID NO: 20351 - RNA, 22 nt, Artificial Sequence
  Guide Sequence
guuuccacgucugugaaauggg

SEQ ID NO: 20352 - RNA, 22 nt, Artificial Sequence
  Guide Sequence
guuugggucucuugauuguucu

SEQ ID NO: 20353 - RNA, 22 nt, Artificial Sequence
  Guide Sequence
uaaaggugugagccacugugcc

SEQ ID NO: 20354 - RNA, 22 nt, Artificial Sequence
  Guide Sequence
uacaaagugccccagcagagac

SEQ ID NO: 20355 - RNA, 22 nt, Artificial Sequence
  Guide Sequence
uacaagugugagccacugugcc

SEQ ID NO: 20356 - RNA, 22 nt, Artificial Sequence
  Guide Sequence
uacccacagugagaauuagaug

SEQ ID NO: 20357 - RNA, 22 nt, Artificial Sequence
  Guide Sequence
uagaugagauagaugcauuuga

SEQ ID NO: 20358 - RNA, 22 nt, Artificial Sequence
  Guide Sequence
uagaugcauuugaaaccacaaa

SEQ ID NO: 20359 - RNA, 22 nt, Artificial Sequence
  Guide Sequence
uagcuguuacaaagugccccag

SEQ ID NO: 20360 - RNA, 22 nt, Artificial Sequence
  Guide Sequence
uagguagcuguuacaaagugcc

SEQ ID NO: 20361 - RNA, 22 nt, Artificial Sequence
  Guide Sequence
uaguuagguagcuguuacaaag

SEQ ID NO: 20362 - RNA, 22 nt, Artificial Sequence
  Guide Sequence
ucaaaugauucuccugccucag

SEQ ID NO: 20363 - RNA, 22 nt, Artificial Sequence
  Guide Sequence
ucacugcaaucuccgccuucug

SEQ ID NO: 20364 - RNA, 22 nt, Artificial Sequence
  Guide Sequence
ucagccucccaaagugcuggga

SEQ ID NO: 20365 - RNA, 22 nt, Artificial Sequence
  Guide Sequence
ucagcucacugcaaucuccgcc

SEQ ID NO: 20366 - RNA, 22 nt, Artificial Sequence
  Guide Sequence
ucaggggcaugaggaagaggcg

SEQ ID NO: 20367 - RNA, 22 nt, Artificial Sequence
  Guide Sequence
ucaguuuccacgucugugaaau

SEQ ID NO: 20368 - RNA, 22 nt, Artificial Sequence
  Guide Sequence
uccaccugccucggccuuccag

SEQ ID NO: 20369 - RNA, 22 nt, Artificial Sequence
  Guide Sequence
uccacgucugugaaauggggga

SEQ ID NO: 20370 - RNA, 22 nt, Artificial Sequence
  Guide Sequence
uccagagugcugggauuaaagg

SEQ ID NO: 20371 - RNA, 22 nt, Artificial Sequence
  Guide Sequence
ucccaaagugcugggauuacaa

SEQ ID NO: 20372 - RNA, 22 nt, Artificial Sequence
  Guide Sequence
ucccuucccuugggugaggggg

SEQ ID NO: 20373 - RNA, 22 nt, Artificial Sequence
  Guide Sequence
ucccuugggugagggggcccag

SEQ ID NO: 20374 - RNA, 22 nt, Artificial Sequence
  Guide Sequence
uccgccuucuggguucaaauga

SEQ ID NO: 20375 - RNA, 22 nt, Artificial Sequence
  Guide Sequence
uccucccuucccuugggugagg

SEQ ID NO: 20376 - RNA, 22 nt, Artificial Sequence
  Guide Sequence
uccugccucagccucccaaagu

SEQ ID NO: 20377 - RNA, 22 nt, Artificial Sequence
  Guide Sequence
uccuggucugggucucuuuuuu

SEQ ID NO: 20378 - RNA, 22 nt, Artificial Sequence
  Guide Sequence
ucgcccaggcuggagugcagug

SEQ ID NO: 20379 - RNA, 22 nt, Artificial Sequence
  Guide Sequence
ucggccuuccagagugcuggga

SEQ ID NO: 20380 - RNA, 22 nt, Artificial Sequence
  Guide Sequence
ucggggugcccaccuguggugg

SEQ ID NO: 20381 - RNA, 22 nt, Artificial Sequence
  Guide Sequence
ucucagcucacugcaaucuccg

SEQ ID NO: 20382 - RNA, 22 nt, Artificial Sequence
  Guide Sequence
ucuccgccuucuggguucaaau

SEQ ID NO: 20383 - RNA, 22 nt, Artificial Sequence
  Guide Sequence
ucuccugccucagccucccaaa

SEQ ID NO: 20384 - RNA, 22 nt, Artificial Sequence
  Guide Sequence
ucucuugauuguucuucagggg

SEQ ID NO: 20385 - RNA, 22 nt, Artificial Sequence
  Guide Sequence
ucucuugcucugucgcccaggc

SEQ ID NO: 20386 - RNA, 22 nt, Artificial Sequence
  Guide Sequence
ucucuuuuuugagucucuugcu

SEQ ID NO: 20387 - RNA, 22 nt, Artificial Sequence
  Guide Sequence
ucugggucucuuuuuugagucu

SEQ ID NO: 20388 - RNA, 22 nt, Artificial Sequence
  Guide Sequence
ucuggguucaaaugauucuccu

SEQ ID NO: 20389 - RNA, 22 nt, Artificial Sequence
  Guide Sequence
ucugguuugggucucuugauug

SEQ ID NO: 20390 - RNA, 22 nt, Artificial Sequence
  Guide Sequence
ucugucgcccaggcuggagugc

SEQ ID NO: 20391 - RNA, 22 nt, Artificial Sequence
  Guide Sequence
ucugugaaaugggggaauaccc

SEQ ID NO: 20392 - RNA, 22 nt, Artificial Sequence
  Guide Sequence
ucuucaggggcaugaggaagag

SEQ ID NO: 20393 - RNA, 22 nt, Artificial Sequence
  Guide Sequence
ucuugauuguucuucaggggca

SEQ ID NO: 20394 - RNA, 22 nt, Artificial Sequence
  Guide Sequence
ucuugcucugucgcccaggcug

SEQ ID NO: 20395 - RNA, 22 nt, Artificial Sequence
  Guide Sequence
ucuuuuuugagucucuugcucu

SEQ ID NO: 20396 - RNA, 22 nt, Artificial Sequence
  Guide Sequence
ugaaaccacaaaucggggugcc

SEQ ID NO: 20397 - RNA, 22 nt, Artificial Sequence
  Guide Sequence
ugaaaugggggaauacccacag

SEQ ID NO: 20398 - RNA, 22 nt, Artificial Sequence
  Guide Sequence
ugagaauuagaugagauagaug

SEQ ID NO: 20399 - RNA, 22 nt, Artificial Sequence
  Guide Sequence
ugagauagaugcauuugaaacc

SEQ ID NO: 20400 - RNA, 22 nt, Artificial Sequence
  Guide Sequence
ugagccacugugccuggccacu

SEQ ID NO: 20401 - RNA, 22 nt, Artificial Sequence
  Guide Sequence
ugagccacugugccuggucugg

SEQ ID NO: 20402 - RNA, 22 nt, Artificial Sequence
  Guide Sequence
ugaggaagaggcgcuuccuccc

SEQ ID NO: 20403 - RNA, 22 nt, Artificial Sequence
  Guide Sequence
ugagucucuugcucugucgccc

SEQ ID NO: 20404 - RNA, 22 nt, Artificial Sequence
  Guide Sequence
ugauccaccugccucggccuuc

SEQ ID NO: 20405 - RNA, 22 nt, Artificial Sequence
  Guide Sequence
ugauucuccugccucagccucc

SEQ ID NO: 20406 - RNA, 22 nt, Artificial Sequence
  Guide Sequence
ugauuguucuucaggggcauga

SEQ ID NO: 20407 - RNA, 22 nt, Artificial Sequence
  Guide Sequence
ugcaaucuccgccuucuggguu

SEQ ID NO: 20408 - RNA, 22 nt, Artificial Sequence
  Guide Sequence
ugcaguggcgccaucucagcuc

SEQ ID NO: 20409 - RNA, 22 nt, Artificial Sequence
  Guide Sequence
ugcauuugaaaccacaaaucgg

SEQ ID NO: 20410 - RNA, 22 nt, Artificial Sequence
  Guide Sequence
ugcccaccugugguggguaguu

SEQ ID NO: 20411 - RNA, 22 nt, Artificial Sequence
  Guide Sequence
ugccccagcagagacccccuug

SEQ ID NO: 20412 - RNA, 22 nt, Artificial Sequence
  Guide Sequence
ugccucagccucccaaagugcu

SEQ ID NO: 20413 - RNA, 22 nt, Artificial Sequence
  Guide Sequence
ugccucggccuuccagagugcu

SEQ ID NO: 20414 - RNA, 22 nt, Artificial Sequence
  Guide Sequence
ugccuggucugguuugggucuc

SEQ ID NO: 20415 - RNA, 22 nt, Artificial Sequence
  Guide Sequence
ugcucugucgcccaggcuggag

SEQ ID NO: 20416 - RNA, 22 nt, Artificial Sequence
  Guide Sequence
ugcugggauuaaaggugugagc

SEQ ID NO: 20417 - RNA, 22 nt, Artificial Sequence
  Guide Sequence
ugcugggauuacaagugugagc

SEQ ID NO: 20418 - RNA, 22 nt, Artificial Sequence
  Guide Sequence
uggagugcaguggcgccaucuc

SEQ ID NO: 20419 - RNA, 22 nt, Artificial Sequence
  Guide Sequence
uggcgccaucucagcucacugc

SEQ ID NO: 20420 - RNA, 22 nt, Artificial Sequence
  Guide Sequence
ugggauuaaaggugugagccac

SEQ ID NO: 20421 - RNA, 22 nt, Artificial Sequence
  Guide Sequence
ugggauuacaagugugagccac

SEQ ID NO: 20422 - RNA, 22 nt, Artificial Sequence
  Guide Sequence
ugggggaauacccacagugaga

SEQ ID NO: 20423 - RNA, 22 nt, Artificial Sequence
  Guide Sequence
uggguaguuagguagcuguuac

SEQ ID NO: 20424 - RNA, 22 nt, Artificial Sequence
  Guide Sequence
ugggucucuugauuguucuuca

SEQ ID NO: 20425 - RNA, 22 nt, Artificial Sequence
  Guide Sequence
ugggucucuuuuuugagucucu

SEQ ID NO: 20426 - RNA, 22 nt, Artificial Sequence
  Guide Sequence
uggguucaaaugauucuccugc

SEQ ID NO: 20427 - RNA, 22 nt, Artificial Sequence
  Guide Sequence
uggucugggucucuuuuuugag

SEQ ID NO: 20428 - RNA, 22 nt, Artificial Sequence
  Guide Sequence
uggucugguuugggucucuuga

SEQ ID NO: 20429 - RNA, 22 nt, Artificial Sequence
  Guide Sequence
ugguggguaguuagguagcugu

SEQ ID NO: 20430 - RNA, 22 nt, Artificial Sequence
  Guide Sequence
ugguuugggucucuugauuguu

SEQ ID NO: 20431 - RNA, 22 nt, Artificial Sequence
  Guide Sequence
ugucgcccaggcuggagugcag

SEQ ID NO: 20432 - RNA, 22 nt, Artificial Sequence
  Guide Sequence
ugugaaaugggggaauacccac

SEQ ID NO: 20433 - RNA, 22 nt, Artificial Sequence
  Guide Sequence
ugugagccacugugccuggcca

SEQ ID NO: 20434 - RNA, 22 nt, Artificial Sequence
  Guide Sequence
ugugagccacugugccuggucu

SEQ ID NO: 20435 - RNA, 22 nt, Artificial Sequence
  Guide Sequence
ugugccuggucugguuuggguc

SEQ ID NO: 20436 - RNA, 22 nt, Artificial Sequence
  Guide Sequence
ugugguggguaguuagguagcu

SEQ ID NO: 20437 - RNA, 22 nt, Artificial Sequence
  Guide Sequence
uguuacaaagugccccagcaga

SEQ ID NO: 20438 - RNA, 22 nt, Artificial Sequence
  Guide Sequence
uguucuucaggggcaugaggaa

SEQ ID NO: 20439 - RNA, 22 nt, Artificial Sequence
  Guide Sequence
uuaaaggugugagccacugugc

SEQ ID NO: 20440 - RNA, 22 nt, Artificial Sequence
  Guide Sequence
uuacaaagugccccagcagaga

SEQ ID NO: 20441 - RNA, 22 nt, Artificial Sequence
  Guide Sequence
uuacaagugugagccacugugc

SEQ ID NO: 20442 - RNA, 22 nt, Artificial Sequence
  Guide Sequence
uuagaugagauagaugcauuug

SEQ ID NO: 20443 - RNA, 22 nt, Artificial Sequence
  Guide Sequence
uuagguagcuguuacaaagugc

SEQ ID NO: 20444 - RNA, 22 nt, Artificial Sequence
  Guide Sequence
uucaaaugauucuccugccuca

SEQ ID NO: 20445 - RNA, 22 nt, Artificial Sequence
  Guide Sequence
uucaggggcaugaggaagaggc

SEQ ID NO: 20446 - RNA, 22 nt, Artificial Sequence
  Guide Sequence
uuccacgucugugaaauggggg

SEQ ID NO: 20447 - RNA, 22 nt, Artificial Sequence
  Guide Sequence
uuccagagugcugggauuaaag

SEQ ID NO: 20448 - RNA, 22 nt, Artificial Sequence
  Guide Sequence
uucccuugggugagggggccca

SEQ ID NO: 20449 - RNA, 22 nt, Artificial Sequence
  Guide Sequence
uuccucccuucccuugggugag

SEQ ID NO: 20450 - RNA, 22 nt, Artificial Sequence
  Guide Sequence
uucuccugccucagccucccaa

SEQ ID NO: 20451 - RNA, 22 nt, Artificial Sequence
  Guide Sequence
uucuggguucaaaugauucucc

SEQ ID NO: 20452 - RNA, 22 nt, Artificial Sequence
  Guide Sequence
uucuucaggggcaugaggaaga

SEQ ID NO: 20453 - RNA, 22 nt, Artificial Sequence
  Guide Sequence
uugaaaccacaaaucggggugc

SEQ ID NO: 20454 - RNA, 22 nt, Artificial Sequence
  Guide Sequence
uugagucucuugcucugucgcc

SEQ ID NO: 20455 - RNA, 22 nt, Artificial Sequence
  Guide Sequence
uugauuguucuucaggggcaug

SEQ ID NO: 20456 - RNA, 22 nt, Artificial Sequence
  Guide Sequence
uugcucugucgcccaggcugga

SEQ ID NO: 20457 - RNA, 22 nt, Artificial Sequence
  Guide Sequence
uugggucucuugauuguucuuc

SEQ ID NO: 20458 - RNA, 22 nt, Artificial Sequence
  Guide Sequence
uuguucuucaggggcaugagga

SEQ ID NO: 20459 - RNA, 22 nt, Artificial Sequence
  Guide Sequence
uuuccacgucugugaaaugggg

SEQ ID NO: 20460 - RNA, 22 nt, Artificial Sequence
  Guide Sequence
uuugaaaccacaaaucggggug

SEQ ID NO: 20461 - RNA, 22 nt, Artificial Sequence
  Guide Sequence
uuugagucucuugcucugucgc

SEQ ID NO: 20462 - RNA, 22 nt, Artificial Sequence
  Guide Sequence
uuugggucucuugauuguucuu

SEQ ID NO: 20463 - RNA, 22 nt, Artificial Sequence
  Guide Sequence
uuuugagucucuugcucugucg

SEQ ID NO: 20464 - RNA, 22 nt, Artificial Sequence
  Guide Sequence
uuuuugagucucuugcucuguc

SEQ ID NO: 20465 - RNA, 22 nt, Artificial Sequence
  Guide Sequence
uuuuuugagucucuugcucugu

SEQ ID NO: 20466 - RNA, 20 nt, Artificial Sequence
  Guide Sequence
aaacugacaccucagggaca

SEQ ID NO: 20467 - RNA, 17 nt, Artificial Sequence
  17 nucleotide guide sequence 1
cugacaccucagggaca

SEQ ID NO: 20468 - RNA, 17 nt, Artificial Sequence
  17 nucleotide guide sequence 2
acugacaccucagggac

SEQ ID NO: 20469 - RNA, 17 nt, Artificial Sequence
  17 nucleotide guide sequence 3
aacugacaccucaggga

SEQ ID NO: 20470 - RNA, 17 nt, Artificial Sequence
  17 nucleotide guide sequence 4
aaacugacaccucaggg

---

The invention claimed is:

1. An isolated guide RNA molecule (gRNA) that targets a mutant Ribosomal Protein S19 (RPS19) allele, wherein the gRNA comprises a CRISPR RNA (crRNA) molecule comprising the nucleic acid sequence set forth in SEQ ID NOs: 6269, 6357, 6449, 6315, 6405, or 6388.

2. The isolated gRNA of claim 1, wherein the crRNA molecule comprises the nucleic acid sequence set forth in SEQ ID NO: 6269.

3. An isolated gRNA that targets a mutant RPS19 allele, wherein the gRNA comprises a crRNA molecule consisting of the nucleic acid sequence set forth in SEQ ID NO: 6269, 6357, 6449, 6315, 6405, or 6388.

4. The isolated gRNA of claim 3, wherein the crRNA molecule consists of the nucleic acid sequence set forth in SEQ ID NO: 6269.

5. The isolated gRNA of claim 3, wherein the crRNA molecule consists of the nucleic acid sequence set forth in SEQ ID NO: 6357.

6. The isolated gRNA of claim 3, wherein the crRNA molecule consists of the nucleic acid sequence set forth in SEQ ID NO: 6449.

7. The isolated gRNA of claim 3, wherein the crRNA molecule consists of the nucleic acid sequence set forth in SEQ ID NO: 6315.

8. The isolated gRNA of claim 3, wherein the crRNA molecule consists of the nucleic acid sequence set forth in SEQ ID NO: 6405.

9. The isolated gRNA of claim 3, wherein the gRNA comprises a crRNA consisting of the nucleic acid sequence set forth in SEQ ID NO: 6388.

10. A composition comprising the isolated guide RNA molecule of claim 1, a donor DNA template for homology directed repair (HDR), alteration, or replacement of a target sequence of the RPS19 allele, one or more CRISPR nucleases or sequences encoding the one or more CRISPR nucleases, and one or more tracrRNA molecules or sequences encoding the one or more tracrRNA molecules.

* * * * *